United States Patent 11,602,557 (BUNYAVIRALES VACCINE) - sequence listing, part 4

SEQ ID NO: 4421 - RNA, 3480 nt, Artificial Sequence
  derived and/or modified CDS sequence (wt) from RVFV(ZS-6365)__DQ380205.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaagaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4422 - RNA, 3480 nt, Artificial Sequence
  derived and/or modified CDS sequence (wt) from RVFV(MP-12)__DQ380208.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4423 - RNA, 3480 nt, Artificial Sequence
  derived and/or modified CDS sequence (wt) from RVFV(T1)__DQ380201.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4424 - RNA, 3480 nt, Artificial Sequence
  derived and/or modified CDS sequence (wt) from RVFV(1853/78)__DQ380220.1__NSm-Gn-Gc
augauugaaggagcuugggauucacucagagaggaggagaugccagaggagcucuccuguuccauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguagacagaugacaggugcuagccuaaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccucgauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggguugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguguucaguucuauugcaauaauuuguuuagcuauucuuuauagggugcucaaaugcuuaaagauugccccaaggaaaguucugaauccacuaauguggauuacagccuucaucagauggguguauaagaagaugguugccagaguggcagacaauauuaaucaagugaacagggagauaggauggauggaaggaggucaguugguucuaggaaacccugccccuauuccucgucaugccccaauuccacguuauagcacauaccuaaugcuacuacuaauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguuccuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugccagauacuacacuucacuguaccugaaguagaggaggaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugcugcuacuaagaaggccucauag

SEQ ID NO: 4425 - RNA, 3480 nt, Artificial Sequence
  derived and/or modified CDS sequence (wt) from RVFV(CAR-R1622)__DQ380219.1__NSm-Gn-Gc
augauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguuuaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcguuacaggaucacagaguccuucuaccgagauuacacucaaguauccagggauaucccaguccucagggggggacauagggguucacauggcacacgaugaucagucaguuagcuccaaaauaguagcucacugcccuccccaggacccaugcuuagugcacggcugcauagugugugcucauggccugauaaauuaccagugucacacugcucucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugccccuauuccucgucaugccccaaucccacguuauagcacauaccuaaugcuacugcuaauugucucauaugcaucagcauguucagaacuaauucaggcaagcuccagaaucacuacuugcuccacagagggugucaacaccaaguguagacugucugguacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacaaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagccaaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugccagauacuacacuucacuguaccugaaguagaggaggaguuuauguacucuugugauggagaugagcggccucuauuagugaaagggacccugauagcuauugauccauuugaugauaggcgggaagcagggggagaaucaacaguugugaauccaaaaucuggaucuuggaauuucuuugacugguuuucuggacucaugaguugguuuggagggccucucaaaacuauacuccucauuugccuguauguugcauuaucaauugggcucuuuuuccuccucauauaucuuggaagaacagggcucucuaaaauguggcuugcugcuacuaagaaggccucauag

SEQ ID NO: 4426 - RNA, 3480 nt, Artificial Sequence
  derived and/or modified CDS sequence (wt) from RVFV(2250/74)__DQ380209.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugccgauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaaaguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaguguggaggauggggguguggguguuuuaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccaaggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4427 - RNA, 3480 nt, Artificial Sequence
  derived and/or modified CDS sequence (wt) from RVFV(2007000094)__EU574055.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4428 - RNA, 3480 nt, Artificial Sequence
  derived and/or modified CDS sequence (wt) from RVFV(ZM-657)__DQ380204.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaagccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4429 - RNA, 3480 nt, Artificial Sequence
  derived and/or modified CDS sequence (wt) from RVFV(ZH-548M12)__M25276.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagaaaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4430 - RNA, 3480 nt, Artificial Sequence
  derived and/or modified CDS sequence (wt) from RVFV(ZH-501-777)__DQ380202.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacccuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaaggggguaaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4431 - RNA, 3480 nt, Artificial Sequence
  derived and/or modified CDS sequence (wt) from RVFV(T-46 (228113))__DQ380199.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaaaggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4432 - RNA, 3480 nt, Artificial Sequence
  derived and/or modified CDS sequence (wt) from RVFV(OS-3)__DQ380184.1__NSm-Gn-Gc
augauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4433 - RNA, 3480 nt, Artificial Sequence
  derived and/or modified CDS sequence (wt) from RVFV(Sudan 86-2010)__JQ820489.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacccuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcaaaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauaggguacucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuacugauugucucauaugcaucagcauguucagaacugauucaggcaaguuccagaaucaccacuugcuccacagagggugucaacaccaaguguagacugucuggcacagcauugaucagggcagggucaguuggggcggaggcuuguuugauguugaagggggucaaggaagaucaaaccaaguucuuaaagauaaaaacugucucaagugagcuaucgugcagggagggccagagcuauuggacuggguccuucagccccaagugccugagcucaaggagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguuaucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaaucugacagguugcuauucuugcaaugcaggggccagaguuugccugucuaucacauccacaggaacugggacucucucugcccacaauaaggacgggucucugcauauaguucucccaucagagaaugggacaaaagaucagugucagauacuacauuucaccguaccugaaguagaagaggaguuuauguacucuugugauggagaugagcggccucuguuagugaaagggacccugauagcuauugacccauuugaugauaggcgggaggcugggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4434 - RNA, 3480 nt, Artificial Sequence
  derived and/or modified CDS sequence (wt) from RVFV(Sudan 28-2010)__JQ820491.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguagugaagagagaacucucagccaaacccauccagagaguugagccuugcacaacuugcauaaccaaaugugagccucauggauugguuguccgaucaacaggguucaagauaucgucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcucuacagagggugucaacaccaaguguagacugucuggcacagcauugaucagggcagggucaguuggggcggaggcuuguuugauguugaagggggucaaggaagaucaaaccaaguucuuaaagauaaaaacuguuucaagugagcuaucgugcagggagggccagagcuauuggacuggguccuuuagccccaagugccugagcucaagaagaugccaucuugucggagaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguuguauuaucaauugggcucuucuuccuccuuauauaucuuggaagaacaggccucucuaaaauguggcuugcugcuacuaagaaggccucauag

SEQ ID NO: 4435 - RNA, 3480 nt, Artificial Sequence
  derived and/or modified CDS sequence (wt) from RVFV(2007004194)__EU574031.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucagcaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4436 - RNA, 3480 nt, Artificial Sequence
  derived and/or modified CDS sequence (wt) from RVFV(73HB1230)__DQ380221.1__NSm-Gn-Gc
augauugaaggagcuugggauucgcucagagaggaggagaugccagaggagcucuccuguucuauaucaggcauaagggagguuaagaccucaagccaggaguuguacagggcauuaaaagccaucauugcugcugauggcuugaacaacaucaccugccaugguaaggauccugaggacaagauuucucucauaaaggguccuccucacaaaaagcggguggggauaguucggugugagagacgaagagaugcuaagcaaguagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccucccaaguaugagcucacugaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagacuaagaaggagcucaaaagcuuugauaucucucagugccccaagauuggaggacaugguaguaagaagugcacuggggacgcagcauuuugcucugcuuaugagugcacugcucaguacgccaaugccuauuguucgcaugcuaaugguucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcucaagugccuaaagauugcuccaaggaaaguucugaauccacuaauguggauuacagccuucaucagauggguguauaagaagaugguugcuagaguggcagacaauauuaaucaagugaacagggaaauaggauggauggaaggaggucaguugguccuagggaacccugccccuauuccucgucaugccccaaucccacguuauagcacauaccuaaugcuacuauugauugucucauaugcaucagcauguucagaacugauucaggcaagcuccagaaucaccacuugcuccacagaggguguuaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuuguuggagagugucaugugaauaggugucugucuuggagggacaaugaaacuucagcagaguuuucauuuguuggggaaagcacgaucaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacgacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuguuggugaaagggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugucuguauguugcauuaucaauugggcucuuuuuccuccuuauauaucuuggaagaacaggccucucuaaaauguggcuugcugcuacuaagaaggccucauag

SEQ ID NO: 4437 - RNA, 3480 nt, Artificial Sequence
  derived and/or modified CDS sequence (wt) from RVFV(1260/78)__DQ380214.1__NSm-Gn-Gc
augauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggacaagauuucucucauaaaggguccuccucacaaaaagcgggugggaauaguucggugugagagacgaagagaugcuaagcaaauagggagagaaaccauggcagggauugcaaugacaguccuuccagccuuagcaguuuuugcucuagcaccuguuguuuuugcugaagacccccaucucagaaacagaccggggaaggggcacaacuacauugacgggaugacucaggaggaugccacaugcaaaccugugacauaugcuggggcauguagcaguuuugaugucuugcuugaaaaagggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggacgauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugcuuauuguucacaugcuaaugggucagggauugugcaaauacaaguaucaggggucuggaagaagccuuuauguguaggguaugagagagugguuguaaagagagaacucucugccaagcccauccagagaguugagccuugcacaacuuguauaaccaaaugugagccucauggauugguuguccgaucaacaggguucaaaauaucaucugcaguugcuugugcuagcggaguuugcgucacaggaucgcagaguccuuccaccgagauuacacucaaguauccagggauaucccaguccucugggggggacauagggguucacauggcacaugaugaccagucaguuagcuccaaaauaguagcucacugcccuccccaggacccgugcuuagugcauggcugcauagugugugcucauggccugauaaauuaccagugucacacugcucucagugccuuuguuguuguguuuguguucaguucuauugcaauaauuuguuuagcuauucuucauagggugcucaagugcuuaaagauugccccaaggaagguucugaauccacuaauguggauuacagccuucaucagauggguguauaagaagaugguugccagaguggcagacaauauuaaucaagugaacagggaaauaggauggauggaaggaggucaguugguucuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagcccuaaaugucugagcucaaggagaugccaucuugucggggaaugucaugugaauaggugucugucuuggagggacaaugaaacuucagcagaguuuucauuuguuggggaaagcacgaccaugcgggagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacacuagagaucacagacuuugauggcucuguuucaacaauagaccugggggcaucaucuagccguuucacaaacugggguucaguuagccucucacuggacgcagagggcauuucaggcucaaauagcuuuucuuucauugaaagcccaggcaaaggauaugcaauuguugaugagccauucucagaaauuccucgacaaggguuccugggggagaucaggugcaauucagaguccucaguccugagugcucaugaaucaugccuuagggcaccaaaccuuaucucauacaagcccaugauagaccaauuggagugcacaacgaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuuccuaaauuugacagguugcuauucuugcaaugcaggggccagggucugccugucuaucacauccacaggaacuggaacccucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugccgcuacuaagaaggccucauag

SEQ ID NO: 4438 - RNA, 3480 nt, Artificial Sequence
  derived and/or modified CDS sequence (wt) from RVFV(ZC-3349)__DQ380207.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuacuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucaggcaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuuuaucagauggauauauaagaagaugguugccagaguggcagacaacauuaaucacgugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuaaggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccuaucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaaccauacuccucauuugccuguauguugcauuaucaauugggcucuuuuuccuccuuauauaucuuggaagaacaggccucucuaaaauguggcuugcugccacuaagaaggccucauag

SEQ ID NO: 4439 - RNA, 3480 nt, Artificial Sequence
  derived and/or modified CDS sequence (wt) from RVFV(Sudan 85-2010)__JQ820488.1__NSm-Gn-Gc
augauugaaggagcuugggauucacucagagaggaggagaugccagaggaacucuccugcucuguaucaggcauaagggagguuaagaccucaagccaggaguuauacagagcauuaaaagccaucauugcugcugauggccugaacaacaucaccugccaugguaagaauccugaggacaagauuucucucauaaagggcccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauugcccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucacagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucguauuuguauucaguucuauugcaauaauuugcuuagccauucuuuauagggugcucaagugcuuaaagauugccccaaggaaaguucugaauccacuaauguggauuacagccuucaucagauggguguauaagaagaugguugcuagaguggcagacaauauuaaucaagugaacagagaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaagaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaacaaguguuuugagcaguguggaggauggggguguggaugcuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacuggggcucaguuagccucucacuggacgcagagggcauuucaggcucaaauagcuuuucuuuuauugagagcccaggcaaaggguaugcaauuguugaugagccauucucagagaucccucggcaaggguucuugggggagauuagguguaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaacaaggacgggucucugcauauaguucucccaucagagaaugggacaaaagaucagugucagauacuacauuucacuguaccugaaguagaagaggaguucauguacucuugugauggagaugagcggccucuguuagugaaagggacccugauagcuauugacccauuugaugauaggcgggaagcagggggggaaucaacaguugugaauccaaaaucuggaucuuggaacuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4440 - RNA, 3480 nt, Artificial Sequence
  derived and/or modified CDS sequence (wt) from RVFV(2007000324)__JF326195.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaagggaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4441 - RNA, 3480 nt, Artificial Sequence
  derived and/or modified CDS sequence (wt) from RVFV(OS-8)__DQ380185.1__NSm-Gn-Gc
augauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauacgcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaggauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugucagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4442 - RNA, 3480 nt, Artificial Sequence
  derived and/or modified CDS sequence (wt) from RVFV(ZINGA J83 R1)__KU978776.1__NSm-Gn-Gc
augauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcugaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4443 - RNA, 3480 nt, Artificial Sequence
  derived and/or modified CDS sequence (wt) from RVFV(2007000253)__JF326192.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccaguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucagcuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4444 - RNA, 3480 nt, Artificial Sequence
  derived and/or modified CDS sequence (wt) from RVFV(MP12)__Z30318.1__NSm-Gn-Gc
augauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagaaaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4445 - RNA, 3480 nt, Artificial Sequence
  derived and/or modified CDS sequence (wt) from RVFV(BIME-01)__KX609032.1__NSm-Gn-Gc
augauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4446 - RNA, 3480 nt, Artificial Sequence
  derived and/or modified CDS sequence (wt) from RVFV(200803166)__JF311381.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagcccuagcgguuuuugcuuuagcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuuaaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggauccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaacagcauguucagaacugauucaggcaagcuccagaaucaccacuugcuccacagagggugucaacaccaaguguagacugucuggcacagcauugaucagggcagggucaguuggggcagaggcuuguuugauguugaaggggguuaaggaagaucaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagucucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauguaguucucccaucagagaaugggacaaaagaucagugucagauacugcauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4447 - RNA, 3480 nt, Artificial Sequence
  derived and/or modified CDS sequence (wt) from RVFV(Kenya 83 (21445))__DQ380198.1__NSm-Gn-Gc
augauugaaggagcuugggauucacucagagaggaggagaugccagaggagcucuccugcucuauaucaggcauaagggagguuaagaccucaagccaagaguuauacagggcauuaaaagccaucauugcugcugauggcuugaacaacaucaccugccaugguaagaauccugagaacaagauuucucucauaaaggguccuccucacaaaaagcggguggggauaguccggugugagagacgaagagaugcuaagcaaauagggagagaaaccauggcagggauugcaaugacaguccuuccagccuuagcaguuuuugcuuuggcaccuguuguuuuugcugaagacccccaccucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacucgugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaaaaaggggucuuacccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucuguuucgagcauaagggacaguauaaaggaacaauggacucuggucagaccaagagggagcucaaaagcuuugauaucucucagugccccaagauuggagggcaugguaguaagaagugcacuggggacgcagcauucugcucugcuuaugagugcacugcucaguacgccaaugccuauuguucacaugcuaaugggucagggauugugcagauucaaguaucaggggucuggaagaagccuuuauguguaggguaugagagagugguugugaagagagaacucucugccaagcccauccagagaguugagccuugcacaacuugcauaaccaaaugugagccucauggauugguuguccgaucaacaggguucaagauaucaucugcaguugcuugugcuagcgggguuugcgucacaggaucgcagaguccuucuacugagauuacacucaaguauccagggauaucucaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagcuuucaucagauggguguauaagaagaugguugcuagaguggcagacaacauuaaucaagugaacagggaaauaggauggauggaaggaggucaguuggcucuagggaacccugccccuauuccucgucaugccccaaucccacguuauagcacauaccuaaugcuacuauugauugucucauaugcaucagcauguucagaacugauccaggcaagcuccagaaucaccacuugcuccacagagggugucaacaccaaguguagacugucuggcacagcauugaucagggcagggucaguuggggcagaggcuuguuugauguugaagggggucaaggaggaucaaaccaaauucuuaaagauaaaaacagucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucagguucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaccccuuuguugucuuugagagggguucucugccacagacaaggaaugacaaaaccuuugcagcuucaaaaggaaauagagguguucaggcuuucucuaagggcucuguacaagcugaucugacucugauguuugacaauuuugagguggacuuugugggagcagccgugucuugugaugccgccuucuugaauuugacagguugcuauucuuguaaugcaggggccagggucugccugucuaucacauccacaggaacuggaacucucucugcccacaauaaggaugggucucugcauauaguucucccaucagagaaugggacaaaagaucagugucagauacuacacuucacuguaccugaaguagaggaggaguuuauguacucuugugauggagaugagcggccucuguuagugaaagggacccugauagcuauugacccauuugaugauaggcgggaagcaggaggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugccgcuacuaagaaggccucauag

SEQ ID NO: 4448 - RNA, 3480 nt, Artificial Sequence
  derived and/or modified CDS sequence (wt) from RVFV(Entebbe)__DQ380191.1__NSm-Gn-Gc
augauugaaggagcuugggauucacucagagaggaggagaugccagaggagcucuccuguuccauaucaggcauaagggagguuaagaccucaagccaggaauuacacagggcauuaaaagccaucauugcugcugauggcuugaacaacaucaccugccaugguaaggauccugaggacaagauuucucucauaaaagguccuccucacaaaaagcggguggggguaguucggugugagagacgaagagacgcuaagcaaauagggagagaaaccauggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugcuagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccaccugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugagacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugucugucuaucacaucuacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4449 - RNA, 3480 nt, Artificial Sequence
  derived and/or modified CDS sequence (wt) from RVFV(763/70)__DQ380188.1__NSm-Gn-Gc
augauugaaggagcuugggauucacucagagaggaggagaugccagaagagcucuccuguuccauaucaggcauaagggaggucaaaaccucaagccaggaauuauauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugggcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagaucacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagcuggcucuagggaacccugccccuauuccucgucaugcuccaauuccacguuauagcacauacuuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugacggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4450 - RNA, 3480 nt, Artificial Sequence
  derived and/or modified CDS sequence (wt) from RVFV(OS-1)__DQ380186.1__NSm-Gn-Gc
augauugagggagcuugggauucacucagagaggaggagaugccagaggagcucuccugcucuauaucaggcauaagggagguuaagaccucaagccaggaauuauacagagcauuaaaagccaucauugcugcugauggcuugaacaacaucaccugccaugguaaggauccugaggacaagauuucucuuauaaaggguccuccucacaaaaagcggguggggauaguccggugugagagacaaagagacgcuaagcaaauagggagagaaaccauggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugcccuccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcucuacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuaaaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4451 - RNA, 3480 nt, Artificial Sequence
  derived and/or modified CDS sequence (wt) from RVFV(2008/00101)__HE687306.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaacuauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcauucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuacacuccucauuugccuguauguugcauuaucaauugggcucuucuuccuccuuauauaucuuggaagaacaggccucucuaaaauguggcuugccgcuacuaagaaggccucauag

SEQ ID NO: 4452 - RNA, 3480 nt, Artificial Sequence
  derived and/or modified CDS sequence (wt) from RVFV(200803162)__JF311377.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaauaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauagccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuaaggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4453 - RNA, 3480 nt, Artificial Sequence
  derived and/or modified CDS sequence (wt) from RVFV(2007002060)__EU574039.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaaaagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugauuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4454 - RNA, 3480 nt, Artificial Sequence
  derived and/or modified CDS sequence (wt) from RVFV(2007002476)__EU574036.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucaaauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4455 - RNA, 3480 nt, Artificial Sequence
  derived and/or modified CDS sequence (wt) from RVFV(2269/74)__DQ380222.1__NSm-Gn-Gc
augauugaaggagcuugggauucgcucagagaggaggagaugccagaggagcucuccuguucuauaucaggcauaagggagguuaagaccucaagccaggaauuguacagggcauuaaaagccaucauugcugcugauggcuugaacaacaucaccugccaugguaaggacccugaggacaagauuucucucauaaaggguccuccucacaaaaaacggguggggauaguucggugugagagacgaagagacgcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacauguaaaccugugacauaugcuggggcauguagcaguuuugaugucuugcucgaaaaggggaaauucccccucuuccagucguaugcucaucauagaacucuacuagaggcaguucacgacacuaucauugcaaaggcugacccaccuagcugugaccuucagagugcucaugggaaucccugcaugaaagagaagcucgugaugaagacacacuguccaaaugacuaccaaucagcucauuaccuuaacaaugacgggaaaauggcuucagucaagugccccccuaaguaugagcucacugaggauugcaacuuuuguaggcagaugacaggugcuagccugaagaaggggucuuauccucuccaggacuuauuuugucagucaagugaggaugaugggucaaaauuaaaaacaaaaaugaaaggggucugcgaagugggaguucaagcacuaaaaaagugugauggccaacucagcacugcacaugagguugugcccuucgcaguguuuaagaacucaaagaagguuuaucuugauaagcuugaccuuaagacugaggaaaaucugcuaccagacucauuugucugcuucgagcauaaaggacaacauaaaggaacaauggacucuggucagaccaagagggagcucaaaagcuuugauaucucucagugccccaagauuggaggacaugguagcaagaagugcacuggggacgcagcauuuugcucugcuuaugagugcacugcucaguacgccaaugccuauuguucacaugcuaaugggucaggaauugugcagauacaagugucaggggucuggaagaagccuuuauguguaggguaugagagagugguuguaaagagagaacucucugccaagcccauccagagaguugagccuugcacaacuuguauaaccaaaugcgagccucauggacugguuguccgaucaacaggguucaagauaucaucugcaguugcuugugcuagcggaguuugcgucacaggaucgcagaguccuucuaccgagauuacacucaaguauccaggaauaucucaguccucugggggggacauagggguucacauggcacacgacgaucagucaguuagcuccaaaauaguagcucacugccccccccaggacccgugcuuagugcauggcugcauagugugugcucauggccugauaaauuaccagugucacacugcucucagugccuuuguuguuguguucguguucagcucuguugcaauaauuuguuuggccauucuuuauaaggugcucaagugccuaaagauugccccaaagaaaguucugaauccgcuaauguggauuacugccuucaucagauggguauauaagaagaugguugccagaguggcagauaauauaaaucaagugaacagggaaauaggauggauggaaggaggucaguuggcucuagggaacccugccccuauuccucgucacgcuccaaucccacgcuauagcacauaccuaaugcuacuacugauugucucauaugcgucagcauguucagaacugauucaggcaagcucuaggauuaccacuugcuccacagaaggugucaacaccaaguguaggcugucuggcacagcauuaauuagggcagggucaguuggggcagaggcuuguuugauguuaaagggggucaaggaagaccaaaccaaguucuugaagauaaaaacugucucaagugagcuaucgugcagggagggccagagcuacuggacuggguccuuuagccccaaaugucugagcucaaggagaugccaucuugucggggaaugucaugugaauaggugcuugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaccugcagucaguuagaaaagaggcccuuagaguuuuuaacuguaucgauugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucauucauugagagcccaggcaaaggguaugcaauuguugaugagccauucucagaaauuccucggcaaggguuccugggggagaucaggugcaacucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaagaaaugacaaaacuuuugcagcuucaaaaggaaauagggguguucaagcuuucucuaagggcucugugcaagcugaucuaacucugauguuugacaauuuugagguggacuuugugggagcagccgugucuugugaugccgccuucuuaaauuugacagguugcuauucuugcaaugcaggggccagggucugccugucuaucacauccacaggaacuggaacucucucugcccacaacaaggaugggucucugcauauaguucucccaucagaaaauggaacaaaagaucagugucagauacuacacuucacugugccugagguagaggaggaguuuauguacucuugugauggagaugagcggccuuuguuagugaaggggacccugauagccauugauccauuugaugauaggcgggaagcaggaggggaaucaacaguugugaauccaaaaucuggaucuuggaauuucuuugacugguucucuggacucaugaguugguuuggagggccucuuaagaccauacuccucauaugccuguauguugcauuaucaauugggcucuuuuuccuucuuauauaucuuggaagaacaggucucucuaaaauguggcuugcugcuacuaagaaggcuucauag

SEQ ID NO: 4456 - RNA, 3480 nt, Artificial Sequence
  derived and/or modified CDS sequence (wt) from RVFV(73HB1449)__DQ380211.1__NSm-Gn-Gc
augauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggacaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4457 - RNA, 3480 nt, Artificial Sequence
  derived and/or modified CDS sequence (wt) from RVFV(SA-51 (Van Wyck))__DQ380195.1__NSm-Gn-Gc
augauugaaggagcuugggauucacucagagaggaggagaugccagaggagcucuccuguucuauaucaggcauaagggagguuaagaccucaagccaggaauuauacagggcauuaaaagccaucauugcugcugauggcuugaacaacaucaccugccaugguaaggauccugaggacaagaucucucucauaaaggguccuccucacaaaaaacggguggggauaguucggugugagagacgaagagacgcuaagcaaauagggagagaaaccauggcagggauugcaaugacaguccuuccagccuuagcaguuuuugcuuuggcaccuguuguuuuugcugaagacccccaucucagaaacagaccagggaagggacacaacuacauugacgggaugacucaggaggaugccacauguaaaccugugacauaugcuggggcauguagcaguuuugaugucuugcucgaaaagggaaaauuuccccuuuuucagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaacgacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggaaaaucugcuaccagacucauuugucugcuucgagcauaagggacaguauaaaggaacaauggacucuggucagacuaagagggagcucaagagcuuugauaucucucagugccccaagauuggaggacgugguagcaagaagugcacuggggacgcagcauuuugcucugcuuaugagugcacugcucaauacgccaaugccuauuguucacaugcuaaugggucaggaauugugcagauacaaguaucaggggucuggaagaagccuuuauguguaggauaugagagagugguugugaaaagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacagagauuacacucaaguacccagggauaucccaguccucuggaggggacauagggguucacauggcacacgaugaucagucaguuagcuccaaaauaguagcucacugccccccccaagacccgugcuuagugcauggcugcauagugugugcucauggccugauaaauuaccagugucacacugcucucagugccuuuguuguuguguucguauucagcucuguugcaauaaucuguuuagccauucuuuauaaggugcucaagugccuaaagauugccccaaggaaaguucugaauccacuaauguggauuacugccuucaucagauggguguauaagaagaugguugccagaguggcagacaauauuaaucaagugaacagggagauaggauggauggaaggaggucaguuggcucuagggaauccugccccuauuccucgucaugcuccaauuccacguuauagcacauaccuaaugcuacuauugauugucucauaugcaucagcaugcucagaacugauucaggcaagcuccagaaucaccacuugcucuacagaaggugucaacaccaaguguaggcugucuggcacagcauuaaucagggcagggucaguuggggcagaggcuuguuugauguugaagggggucaaggaagaccaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggauaaugaaacuucagcagaguuuucauuuguuggggaaagcacgaccaugcgagaaaauaaguguuuugagcaguguggaggauggggauguggguguuucaaugugaacccaucuugcuuauuugugcacacguaucugcagucaguuagaaaagaggcccuuagaguuuuuaacuguaucgauugggugcauaaacucacucuggaggucacagauuuugauggcucuguuucaacaauagacuugggagcaucaucuagccguuucacaaacugggguucaguuagccucucacuggaugcagagggcauuucaggcucaaauagcuuuucuuucauugagagcccaggcaaaggguaugcaauuguugaugagccauucucagaaauuccucggcaaggguucuugggggagaucaggugcaauucagaaucuucaguucugagugcccacgaaucaugccuuagggcaccaaaccuuaucucauacaagcccaugauagaucaguuggagugcacaacaaaucugauugaucccuuuguugucuuugagagggguucccugccacagacaaggaaugacaaaaccuuugcagcuucaaaaggaaacagggguguucaagcuuucucuaagggcucuguacaagcugaucuaacucugauguuugacaauuuugagguggacuuugugggagcagccgugucuugugaugcugccuucuuaaauuugacagggugcuauucuugcaaugcaggggccagggucugccugucuaucacauccacaggaacuggaacccucucugcccacaauaaggaugggucucugcauauaguucuuccaucagagaauggaacaaaagaucagugucagauacuacacuucacuguuccugaaguagaggaagaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuucuuauauaucuuggaagaacaggucuuucuaaaauguggcuugcugcuacuaagaaggccucauag

SEQ ID NO: 4458 - RNA, 3480 nt, Artificial Sequence
  derived and/or modified CDS sequence (wt) from RVFV(KEN/Gar-Msq/131B-04/06)__HM586972.1__NSm-Gn-Gc
augauugaaggagcuugggauucauuuagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4459 - RNA, 3480 nt, Artificial Sequence
  derived and/or modified CDS sequence (wt) from RVFV(2007001107)__EU574047.1__NSm-Gn-Gc
augauugaaggagcuugggauucacucagagaggaggagaugccagaggagcucuccugcucuguaucaggcauaagggagguuaagaccucaaaccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggggcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4460 - RNA, 3480 nt, Artificial Sequence
  derived and/or modified CDS sequence (wt) from RVFV(ANK-3837)__DQ380215.1__NSm-Gn-Gc
augauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4461 - RNA, 3480 nt, Artificial Sequence
  derived and/or modified CDS sequence (wt) from RVFV(Lunyo)__KU167026.1__NSm-Gn-Gc
augauugaaggagcuugggauucacucagagaggaggagaugccagaagaacucuccuguucuauaucaggcauaagagagguuaaaaccucaagccaggaauuauacagggcauuaaaagccaucauugcugcugauggcuugaacaacaucaccugccaugguaaggauccugaggacaagauuucucucauaaaggguccuccucacaaaaagcggguggggauaguucggugugagagacgaagagacgcuaagcaaauagggagagaaaccauggcagggauugcaaugacaguccuuccagccuuagcaguuuuugcuuuggcaccuguuguuuuugcugaagacccucaucucagaaauagaccagggaaggggcacaacuacauugacgggaugacucaggaggaugccacauguaaaccugugacauaugcuggggcauguagcaguuuugaugucuugcuugaaaagggaaaauuuccccucuuccagucguaugcucaucauagaacucuacuggaggcaguucaugacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguaggcagaugacaggugcuagcuugaagaaggggucuuauccccuccaggaccuauuuugucagucaagugaggaugauggaucaaaauuaaaaacaaaaaugaaaggggucugcgaaguugggguucaagcacucaaaaagugugauggccaacucagcacugcacaugagguugugcccuuugcaguguuuaagaacucaaagaagguuuaucuugauaagcuugaccucaagacugaggaaaaucugcuaccagacucauuugucugcuucgagcacaagggacaguauaaaggaacaauggucucuggucagacuaagagggagcucaaaagcuuugauaucucucagugucccaagauuggaggacaugguagcaagaagugcacuggggacgcagcauuuugcucugcuuaugagugcacugcucaauaugccaaugccuauugcucacaugcuaauggaucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccggucaacaggguucaagauaucaucugcaguugcuugugcuagcggaguuugcgucacaggaucgcagaguccuucuaccgagauuacacucaaguauccagggauaucccaguccucugggggggacauagggguucacauggcacaugaugaucagucaguuaguuccaaaauaguagcucacugcccuccccaggacccgugccuagugcauggcugcauagugugugcucauggccugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggucaguuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccagguguaggcugucuggcacagcauuaaucagggcagggucaguuggggcagaggcuuguuugauguuaaagggggucaaggaagaccaaaccaaguucuugaagauaaaaacugucucaagugagcuaucgugcagggagggccagagcuauuggacuggauccuuuagccccaaaugucugagcucaaggagaugccaucuugucggggaaugucaugugaauaggugucugucuuggagggacaaugaaacuucagcagaauuuucauuuguuggggaaagcacgacuaugcgagagaauaaauguuuugagcaguguggaggauggggauguggguguuucaaugugaacccaucuugcuuauuugugcacacguaucugcagucaguuagaaaagaggcccuuagaguuuucaacuguaucgauugggugcauaaacucacucuagagauuacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaauuugauugaucccuuuguugucuuugagagggguucucuaccacagacaaggaaugacaaaaccuuugcagcuucaaaaggaaauagggguguucaagcuuucucuaagggcucuguacaagcugaccuaacucugauguuugacaauuuugagguggacuuugugggggcagccgugucuugugaugccgccuucuuaaauuugacagguugcuauuccugcaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacucaugaguugguuuggagggccccuuaagacuauacuccuuauuugccuguauguagcauuaucaauugggcucuuuuuccuucuuauauaucuuggaagaacaggucucucuaaaauguggcuugcugccacuaagaaagccucauag

SEQ ID NO: 4462 - RNA, 3480 nt, Artificial Sequence
  derived and/or modified CDS sequence (wt) from RVFV(RVFBJ01/2016)__KX785331.1__NSm-Gn-Gc
augauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaagcaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcacccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4463 - RNA, 3480 nt, Artificial Sequence
  derived and/or modified CDS sequence (wt) from RVFV(Ken 199800523)__KU978777.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcacgguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugaaugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggaggggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4464 - RNA, 3480 nt, Artificial Sequence
  derived and/or modified CDS sequence (wt) from RVFV__JQ068143.1__NSm-Gn-Gc
augauugaaggagccugggauucacucagagaggaggagaugccagaagagcucuccuguuccauaucuggcauaagggagguuaagaccucuagccaggaauuauacagggcauuaaaagccaucauugcugcugauggcuugaacaacaucaccugccaugguaaggauccugaggacaagauuucccucauaaaggguccuccucacaagaagcggguggggauaguucggugugagagacgaagggacgcuaagcaaauagggagagaaaccauggcagggauugcaaugacaguccuucccgccuuagcaguuuuugcuuuggcaccuguuguuuuugcugaggacccucaucucagaaacagaccagggaagggacacaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugacccaccuagcugugaucuucagagugcucaugggaaccccugcaugaaagagaaacucgugaugaagacacacuguccaaaugacuaccagucagcucauuaucucaacaaugacgggaaaauggcuucagucaagugcccuccuaaguaugagcucacugaggacugcaacuuuuguaggcagaugacaggugcuagcuugaagaaggggucuuauccucuccaggacuuauuuugucagucaagugaggaugaugggucaaaauuaaagacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaagaaaaucugcuaccagacucauuugucugcuuugagcauaaaggacaguauaaaggaacaauagacucuggucagacuaagagagagcucaaaagcuuugauaucucucagugccccaagauuggaggacaugguagcaagaagugcacuggggacgcagcauuuugcucugcuuaugaguguacugcucaguaugccaaugccuauuguucacaugcuaaugggucugggauuguacagauacaaguguccggggucuggaagaagccucuguguguaggauaugagagagugguugugaagagagaacucucugccaagcccauccagagaguugagccuugcacaacuugcauaaccaaaugugagccucauggauugguuguccgaucaacaggguuuaagauaucaucugcaguugcuugugcuagcgggguuugcgucacaggaucgcagagcccuucuacugagaucacucuuaaguauccagggauaucccaauccucugggggggacauaggaguucacauggcacaugaugaucagucaguuagcuccaaaauaguggcucacugccccccccaggacccgugccuagugcauggcugcauagugugugcucauggcuugauaaauuaccagugucacacugcucucagugcuuuuguuguuguauucguauucagcucuguugcaauaauuugucuggccauccuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcuccuauuccucgucaugcuccaauuccacguuauagcacguaucuaaugcuacuauugauuaucucauaugcaucagcauguucagaacugauucaggcaagcuccagaaucacuacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaaccucagcagaauuuucauuuguuggggaaagcacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaauagacuugggggcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggagagaucaggugcaauucagaaucuucuguccugagugcucaugaaucaugccuuagggcuccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaagggcucuguacaagcugaucuaacucugauguuugacaauuuugagguggacuuugugggggcagccgugucuugugaugccgccuucuuaaauuugacagguugcuauuccugcaaugcuggagccagagucugccugucuaucacauccacaggaacuggaacucuuucugcccacaauaaggaugggucucugcacauaguucuuccaucagagaauggaacaaaagaucagugucagauacuacacuucacuguaccugagguggaggaggaguuuauguacucuugugauggagaugagcggccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucucggaagaacaggucucucuaaaauguggcuugcugccacuaagaaagccucauag

SEQ ID NO: 4465 - RNA, 3480 nt, Artificial Sequence
  derived and/or modified CDS sequence (wt) from RVFV(200803169)__JF311384.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaagguagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagauuccucggcaaggguucuugggggaggucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4466 - RNA, 3480 nt, Artificial Sequence
  derived and/or modified CDS sequence (wt) from RVFV(2007002445)__EU574037.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuauauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuauacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4467 - RNA, 3480 nt, Artificial Sequence
  derived and/or modified CDS sequence (wt) from RVFV(Hv-B375)__DQ380218.1__NSm-Gn-Gc
augauugaaggagcuugggauucacucagagagggggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuggcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagaaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguucaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucaugguuugguuguccgaucaacaggguucaagauaucaucugcaguugcuugugcuagcggaguuugcgucacaggaucacagagcccuucuaccgagauuacacucaaguauccagggauaucccaguccucugggggggacauagggguucacauggcacacgaugaucagucaguuagcuccaaaauaguagcucacugcccuccccaggacccaugcuuagugcacggcugcauagugugugcucauggccugauaaauuaccagugucacacugcccucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugcuccuauuccucgucaugccccaauuccacguuauagcacauaccuaaugcuacugcuaauugucucauaugcaucagcauguucagaacuaauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaacucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugaaguagaggaggaguuuauguacucuugugauggagaugagcggccucuauuagugaaagggacccugauagcuauugauccauuugaugauaggcgggaagcagggggagaaucaacaguugugaauccaaaaucuggaucuuggaauuucuuugacugguuuucuggacucaugaguugguuuggagggccucucaaaacuauacuccucauuugccuguauguugcauuaucaauugggcucuuuuuccuccucauauaucuuggaagaacagggcucucuaaaauguggcuugcugcuacuaagaaggccucauag

SEQ ID NO: 4468 - RNA, 3480 nt, Artificial Sequence
  derived and/or modified CDS sequence (wt) from RVFV(clone 13)__DQ380213.1__NSm-Gn-Gc
augauugaaggagcuugggauucacucagagaggaggagaugccagaggagcucuccuguucuauaucaggcauaagagagguuaagaccucaagccaggaguuauacagggcauuaaaagccaucauugcugcugauggcuugaacaacaucaccugccaugguaaggauccugaggauaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagcaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4469 - RNA, 3480 nt, Artificial Sequence
  derived and/or modified CDS sequence (wt) from RVFV(Kenya 57 (Rintoul))__DQ380192.1__NSm-Gn-Gc
augauugaaggagcuugggauucacucagagaggaggagaugccagaggagcucuccuguuccauaucaggcauaagggagguuaagaccucaagccaggaauuacacagggcauuaaaagccaucauugcugcugauggcuugaacaacaucaccugccaugguaaggauccugaggacaagauuucucucauaaaggguccuccucacaaaaagcggguggggguaguucggugugagagacgaagagacgcuaagcaaauagggagagagaccauggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuucucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4470 - RNA, 3480 nt, Artificial Sequence
  derived and/or modified CDS sequence (wt) from RVFV(2007001292)__EU574046.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggauccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaaucucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4471 - RNA, 3480 nt, Artificial Sequence
  derived and/or modified CDS sequence (wt) from RVFV(2007001811)__EU574040.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucacgacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaugauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4472 - RNA, 3480 nt, Artificial Sequence
  derived and/or modified CDS sequence (wt) from RVFV(ANK-6087)__DQ380216.1__NSm-Gn-Gc
augauugaaggagcuugggauucacucagagaggaggagaugccagaggagcucuccuguucuauaucaggcauaagggagguuaagaccucaagccaggaguuauacagggcauuaaaagccaucauugcugcugauggcuugaacaacaucaccugccaugguaaggauccugaggacaagauuucucucauaaaggguccuccucauaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaaaauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcucaacaaaucugauugaccccuuuguuguauuuaagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4473 - RNA, 3480 nt, Artificial Sequence
  derived and/or modified CDS sequence (wt) from RVFV(2007000234)__JF326191.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauaaggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccagaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4474 - RNA, 3480 nt, Artificial Sequence
  derived and/or modified CDS sequence (wt) from RVFV(SA-75)__DQ380189.1__NSm-Gn-Gc
augauugaaggagcuugggauucacucagagaggaggagaugccagaagagcucuccuguuccauaucaggcauaagggaggucaaaaccucaagccaggaauuguauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcaaggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaccccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4475 - RNA, 3480 nt, Artificial Sequence
  derived and/or modified CDS sequence (wt) from RVFV(KEN07-KUR340)__EF460404.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucuuauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauaggaugcucaagugcuuaaagauugccccaaggauaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucgucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4476 - RNA, 3480 nt, Artificial Sequence
  derived and/or modified CDS sequence (wt) from RVFV(35/74)__JF784387.1__NSm-Gn-Gc
augauugaaggagcuugggauucacucagagaggaggagaugccagaagagcucuccuguuccauaucaggcauaagggaggucaaaaccucaagccaggaauuguauagggcauuaaaagccaucauugcugcugauggcuugaacaacaucaccugccaugguaaggauccugaggauaagauuucucucguaaaggguccuccucacaaaaagcggguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucuggauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4477 - RNA, 3480 nt, Artificial Sequence
  derived and/or modified CDS sequence (wt) from RVFV(200803167)__JF311382.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagaccuccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauugcacucaaguauccagggauaucccaguccucugggggggauauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaagggggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuucgagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuaugcuccucauuugccuguauguugcauuaucaauugggcucuucuuccuccuuauauaucuuggaagaacaggccucucuaaaauguggcuugccgcuacuaagaaggccucauag

SEQ ID NO: 4478 - RNA, 3480 nt, Artificial Sequence
  derived and/or modified CDS sequence (wt) from RVFV(25010-24)__KM210509.1__NSm-Gn-Gc
augauugagagagcuugggauucacucagagaggaggagaugccagaagagcucucuuguuccauaucaggcauaagggagguuaagaccucaagccaggaauuauacagggcauuaaaagcuaucauugcugcugauggcuugaacaacaucaccugccaugguaaggauccugaggacaagauuucucucauaaaggguccuccucacaagaagcgaguggggauaguucggugugagagacgaagagacgcuaagcaaguagggagagaaaccauggcagggauugcaaugacaguccuuccagccuuagcaguuuuugcuuuggcaccuguugucuuugccgaagacccucaucuuagaaacaggccaggaaagggacacaacuacauugacgggaugacucaggaggaugccacauguaaaccugugacauaugcuggggcauguagcaguuuugaugucuugcucgaaaagggaaaauuuccccucuuccagucauacgcucaucauagaacucuacuagaggccguccacgacaccauuauugcaaaggcugauccaccuagcugugaccuucagagugcucaugggaaucccugcaugaaggagaaacucgugaugaagacacacuguccaaaugacuaccagucagcucauuaccuuaacaaugacgggaaaauggccucagucaagugcccuccuaaguaugagcucacugaggacugcaacuuuuguaggcagaugacaggugcuagccugaagaaagggucuuauccucuccaggacuuauuuugucagucaagugaggaugaugggucaaaauuaaaaacaaaaaugaaaggggucugcgaagugggaguucaagcacucaaaaagugugauggccaacucagcacugcacaugagguugugcccuuugcaguauuuaagaacucaaagaagguuuaucuugacaagcuugaccucaagacugaggaaaaucugcuaccagacucauuugucugcuucgagcauaaggggcaguauaaaggaacaauggacucuggucagacaaagagggagcucaaaagcuuugauaucucucagugucccaagauuggagggcaugguagcaagaaauguacuggggacgcagcauucugcucugcuuaugagugcacugcucaauacgccaaugccuauuguucacaugcuaaugggucaggaauuguacagauacaaguauccggggucuggaagaagccuuuguguguaggguaugagagagugguugugaagagagagcucucugccaagcccauccagagaguugagccuugcacaacuuguauaaccaaaugugagccucauggauuaauuguccgaucaacaggguucaagauaucaucugcaguugcuugugcuagcggaguuugcgucacaggaucgcagagcccgucuacugagaucacacucaaguacccagggauaucccaguccucugggggggacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuugucguuguguucguguucagcucuguugcaauaauuuguuuggcuauucuuuauaaggugcucaagugccuaaaaauugccccaaagaaaguucuaaauccacugauguggauuacugcuuucaucagauggguguauaagaagaugguugccagaguggcagacaauaucaaucaagugaacagggaaauaggauggauggaaggaggccaguuagcucuagggaauccugcuccuaucccucgucaugcuccaauuccacguuauagcacauaccuaaugcuacuauugauugucucauaugcaucagcauguucagaacugauucaggccagcuccagaaucacuacuugcuccacagaagguguuaacacuaaguguaggcugucuggcacagcauugaucagggcaggaucaguuggagcagaagcuugucugauguuaaagggggucaaggaugaccaaaccaaguuccugaagauaaaaacugucucaagugagcuaucgugcagggagggccagagcuauuggacuggguccuucagccccaaaugucugagcucaaggaggugccaucuugucggggaaugucaugugaauaggugucugucuuggagggacaaugagacuucagcagaauuuucauuuguuggggaaagcacgaccaugcgagagaacaaguguuuugagcaguguggaggauggggauguggguguuucaacguaaacccaucuugcuuguuugugcacacguaucuacagucagucagaaaagaggcccuuagaguuuuuaacugcauugauugggugcauaaacuuacucuagagaucacagacuuugauggcucuguuucaacaauagacuugggagcuucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggauucuuaggagagaucaggugcaauucagaaucuucaguucugagugcucaugaaucaugccuuagggcgccaaaccuuaucucauacaaaccaaugauagaucaguuggagugcacaacaaaucuaauugauccuuuuguagucuuugagagggguucccugccacaaacaaggaaugacaaaaccuuugcagcuucaaaagggaauagggguguucaagcuuucucuaagggcucuguacaagcugaucuaacucugauguuugacaauuuugagguggacuucgugggagcagccgugucuugugaugccgccuucuugaauuugacagguugcuauucaugcaaugcaggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaagggacccugauagcuauugauccauuugaugauaggcgagaagcagggggggaaucaacaguugugaauccaaaaucuggaucuuggaauuucuuugacugguuuucuggacucaugaguugguuuggagggccucucaagacuauacuccuaauuugccuguauguagcauuaucaauugggcucuuuuuccuucuuauauaucuugggagaacaggucucucuaaaauguggcuugcugcuacuaagaaggccucauag

SEQ ID NO: 4479 - RNA, 3480 nt, Artificial Sequence
  derived and/or modified CDS sequence (wt) from RVFV(Sudan 2V-2007)__JQ820490.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaauaucacuugccaugguaagaauccugaggacaagauuucucucauaaaggguccuccucacaaaaagcgaguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaaugacuaccagucagcucauuaccucaacaaugacgggaaaauggccucagucaagugcccaccuaaguaugagcucacugaggacugcaacuuuuguagacagaugacaggugcuagccugaagaaggggucuuauccucuccaagacuuauuuugucagucgagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaaggucuaucuugauaagcuugaccucaagacugaggagaaucugcuaccagacucauuugucugcuucgagcauaagggacaguauaaaggaacaauggacucuggucagaccaagagggagcucaagagcuuugauaucucucagugccccaagauuggagggcaugguaguaagaagugcacuggggaugcagcauuuugcucugcuuaugaaugcacugcucaguaugccaaugccuauuguucacaugcuaaugggucagggauugugcagauucaaguaucaggggucuggaagaaaccuuuguguguaggguaugagagagugguugugaagagagaacucucugccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggauauagggguucacauggcacacgaugaucagucaguuagcuccaaaauaguagcucacugccccccccaggacccgugcucagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuauugauugucucacaugcaucagcauguucagaacuuauucaggcaagcuccagaaucaccacuugcuccacagagggugucaacaccaaguguagacugucuggcacagcauugaucagggcagggucaguuggggcggaggcuuguuugauguugaagggggucaaggaagaucaaacuaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaauguaaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguuuuugggggagaucaggugcaauucagaguccucaguccuaagugcucaugaaucaugccuuagggcgccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaagacgggucucugcauauaguucucccaucagagaaugggacaaaagaucagugucagauacuacauuuuacuguaccugaaguagaagaggaguuuauguacucuugugauggagaugagcggccucuguuaguaaaagggacccugauggcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4480 - RNA, 3480 nt, Artificial Sequence
  derived and/or modified CDS sequence (wt) from RVFV(SAUDI 200010901)__KU978778.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugggagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaagugggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4481 - RNA, 3480 nt, Artificial Sequence
  derived and/or modified CDS sequence (wt) from RVFV(2373/74)__DQ380194.1__NSm-Gn-Gc
augauugaaggagcuugggauucacucagagaggaggagaugccagaagagcucuccuguuccauaucaggcauaagagagguuaagaccucaagccaggaauuauacagggcacuaaaagccaucauugcugcugauggcuugaacaacaucaccugcuaugguaaggauccugaggacaagauuucucucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucaggaggaugccacauguaaaccugugacauaugcuggggcauguagcaguuuugaugucuugcucgaaaagggaaaauucccccucuuccagucauaugcucaucauagaacucuacuagaggcaguucacgacaccaucauugcaaaggcugacccaccuagcugugaccuccagagugcucaugggaaucccugcaugaaagagaaacucgugaugaagacacacugcccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaggacuuguucugucaaucaagugaggaugauggaucaaaauuaaaaacaaaaaugaaaggggucugcgaaguggggguucaagcacucaaaaagugugauggccaacucagcacugcacaugagguugugccauuugcaguguuuaaaaacucaaagaagguuuaucuugacaagcuugaccucaagacugaggaaaaucugcuaccagacucauuugucugcuucgagcauaagggacaguauaaagggacaauggacucuggucagacuaagagggagcucaaaaguuuugauaucucucagugccccaagauuggaggacaugguagcaagaagugcacuggggacgcagcauuuugcucugcuuaugagugcacugcucaauacgccaaugccuauuguucacaugcuaaugggucaggaauuguacagauacaaguauccggggucuggaagaagccuuuauguguaggauaugagagagugguugugaagagagaacucucugcuaagcccauccagagaguugagccuugcacaacuuguauaaccaaaugcgagccucauggguugguuguccgaucaacaggguucaagauaucuucugcaguugcuugugcuagcggaguuugcgucacaggaucacagagcccuucuaccgagauuacacucaaguauccaggaauaucccaguccucugggggggacauagggguucacauggcacaugaugaucagucaguuagcuccaaaaugguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagguggguguauaagaagaugguugccagaguggcagacaauaucaaucaagugaacagggaaauaggauggauggaaggaggccaguuggcucuagggaacccugccccuauuccucgucaugccccaauuccacguuauagcacauaccuaaugcuacuauugauugucucauaugcaucagcauguucagaacugauucaggcaagcuccagaaucaccaccugcuccacagaaggugucaacaccaaguguaggcugucuggcacagcauuaaucagggcagggucaguuggggcagaggcuuguuugauguuaaagggggucaaagaagaccaaaccaaguucuugaagauaaaaacugucucaagugagcuaucgugcagggaaggccagagcuauuggacuggguccuuuagccccaaaugccugagcucaaggaggugccaucuugucggggaaugucaugugaauaggugucugucuuggagggacaaugaaacuucugcagaauuuucauuuguuggggaaagcacgaccaugcgagagaauaaguguuuugagcaguguggaggauggggauguggguguuucaaugugaauccaucuugcuuauuugugcacacguaucugcagucgguuagaaaagaggcccuuagaguuuucaacuguauugauugggugcauaaacucacucuagagaucacagacuuugauggcucuguuucaacauuagacuugggagcaucaucuagccguuucacaaacugggguucgguuagccucucacuggaugcagagggcauuucaggcucaaauagcuuuucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaaggaaugaaaaaaccuuugcagcuucaaaaggaaauagggguguucaagcuuucuccaagggcucuguacaagcugaucuuacucugauguuugacaauuuugagguggacuuugugggagcagccgugucuugugaugccgccuucuuaaauuuaacagguugcuauuccugcaaugcaggagccagagucugcuugucuaucacauccacaggaacuggaacucucucugcccacaauaaggaugggucucugcacauaguucuuccaucagagaauggaacaaaagaucagugucagauacuacacuucacuguaccugagguggaggaggaguuuauguacucuugugauggagaugagcggccucuauuggugaaggggacccugauagcuauugauccauuugaugauaggcgagaagcaggaggggaaucaacaguugugaauccaaaaucugguucuuggaauuucuuugacugguuuucuggacuuaugaguugguuuggagggccucuuaagaccauacuccuaauuugccuguauguggcauuaucaauugggcucuuuuuccuccuuauauaucuuggaagaacaggucucucuaaaauguggcuugcugccacuaagaaagccucauag

SEQ ID NO: 4482 - RNA, 3480 nt, Artificial Sequence
  derived and/or modified CDS sequence (wt) from RVFV(KEN/Kil-006/07)__HM586966.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggguaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgccacuaagaaggccucauag

SEQ ID NO: 4483 - RNA, 3480 nt, Artificial Sequence
  derived and/or modified CDS sequence (wt) from RVFV(MgH824)__DQ380210.1__NSm-Gn-Gc
augauugaaggagcuugggauucacucagagaggaggagaugccggaggagcucuccuguucuauaucaggcauaagggagguuaagaccucaagccaggaguuauacagggcauuaaaagccaucauugcugccgauggcuugaacaacaucaccugccaugguaaggauccugaggacaagauuucccucauaaaggguccuccucacaaaaagcggguggggauaguucggugugagaggcgaagagaugcuaagcaaauagggagagaaaccauggcagggauugcaaugacaguccuuccagccuuagcaguuuuugcuuuggcaccuguuguuuuugcugaagacccccaucucagaaacagaccagggaagggguacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugacccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcguaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacuacucaguacgccaaugccuauuguucacaugcuaaugggucagggguugugcagauacaagugucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguugacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacuggguacauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucccagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaccccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacauuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaaggacaggccucucuaaaauguggcuugcugccacuaagaaggccucauag

SEQ ID NO: 4484 - RNA, 3480 nt, Artificial Sequence
  derived and/or modified CDS sequence (wt) from RVFV(SA01-1322)__KX096942.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugggagacgaagagauacuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguaggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuaggggacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccagguaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacuuaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4485 - RNA, 3480 nt, Artificial Sequence
  derived and/or modified CDS sequence (wt) from RVFV(Kenya 56 (IB8))__DQ380190.1__NSm-Gn-Gc
augauugaaggagcuugggauucacucagagaggaggagaugccagaagagcucuccuguuccauaucaggcauaagggagguuaaaaccucaagccaggaauuauauagggcauuaaaagccaucauugcugcugauggcuugaacaacaucaccugccaugguaaggauccugaggauaagauuucucucauaaaggguccuccucacaaaaagcagguggggauaguucggugugagagacgaagagacgcuaagcaaauaggaagagaaaccauggcagggauugcaaugacaguccuuccagccuuagcaguuuuugcuuuggcaccuguuguuuuugcugaagacccucaucucagaaacagaccagggaaggggcacaacuacauugacgggaugacucagggggaugccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaauccuugcaugaaggagaaacucgugaugaagacacacuguccaaaagacuaccagucagcucauuaccucaacaaugacgggaaaauggcuucagucaagugcccuccuaaauaugagcucacugaggacugcaauuuuugcaggcagaugacaggugccagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcuaaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaggccuuuguguguaggguaugagagggugguugugaagagagaacucucugcuaagcccauccagagaguugagccuugcacaacuuguauaaccaaaugugagccucauggauugguuguccgaucaacagguuucaagauaucaucugcaguugcuugugcuagcggaguuugcguuacaggaucgcagagcccuucuaccgagauuacacucaaguauccagggaugucccaguccucugggggggacauagggguucauauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagccggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagagagggccagagcuauuggacuggguccuuuagcccuaaaugucugagcucaaggaggugccaucuugucggggaaugucaugugaauaggugucugucuuggagagacaaugaaacuucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaaucugauugaucccuuuguugccuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuccuuauauaucuuggaagaacaggccucucuaaaauguggcuugcugccaccaagaaagccucauag

SEQ ID NO: 4486 - RNA, 3480 nt, Artificial Sequence
  derived and/or modified CDS sequence (wt) from RVFV(KEN/Mal-032/07)__HM586967.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4487 - RNA, 3480 nt, Artificial Sequence
  derived and/or modified CDS sequence (wt) from RVFV(KEN/Gar-008/06)__HM586965.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuugaagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguaaaagaggaguucauguacucuugugauggagaugagcgggcucuguuaaugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4488 - RNA, 3480 nt, Artificial Sequence
  derived and/or modified CDS sequence (wt) from RVFV(Beijing-01)__KX611606.1__NSm-Gn-Gc
augauugaaggagcuugggauucacucagagaggaggagaugccagaagagcucuccuguuccauaucuggcauaagggaggucaagaccucaagccaggaauuauacagggcauuaaaagccaucauugcugcugauggcuugaacaacaucaccugccaugguaaggauccugaggacaaaauuucucucauaaaggguccuccucacaagaagcggguggggauaguucggugugagagacgaagggacgcuaagcaaauagggagagaaaccauggcagggauugcaaugacaguucuucccgccuuagcaguuuuugcuuuggcaccuguuguuuuugcugaggacccucaucucagaaacagaccagggaagggacauaacuacauugacggggugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaagcacucaaaaagugugauggccgacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauagucuuugacugcccuccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuugagggggucaaggaagaccagaccaaguucuuaaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4489 - RNA, 3480 nt, Artificial Sequence
  derived and/or modified CDS sequence (wt) from RVFV(KEN/Bar-035/07)__HM586969.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugacgguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcacggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4490 - RNA, 3480 nt, Artificial Sequence
  derived and/or modified CDS sequence (wt) from RVFV(KEN/Bar-032/07)__HM586968.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaaaugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugugggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucucacacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4491 - RNA, 3480 nt, Artificial Sequence
  derived and/or modified CDS sequence (wt) from RVFV(TAN/Dod-002/07)__HM586971.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguccaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucaggccuggauaaucucucaguggcacacggcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4492 - RNA, 3480 nt, Artificial Sequence
  derived and/or modified CDS sequence (wt) from RVFV(Smithburn)__DQ380193.1__NSm-Gn-Gc
augauugaaggagcuugggauucacucagagaggaggagaugccagaggagcucuccuguuccauaucaggcauaagggagguuaagaccucaagccaggaauuauacagggcauuaaaagccaccauugcugcugauggcuugaacaacaucaccugccaugguaaggauccugaggacaagauuucucucauaaaggguccuccucacaaaaagcggguggggguaguucggugugagagacaaagagacgcuaagcaaauagggagaggaaccauggcagggauugcaaugacagucuuuccagccuuaguaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaucaucauugcaaaggcugauccaccuagcuguaaccuucagagugcucaugggaaucccugcaugaaagagaaacucguaaugaagacauacuguccaaaugacuaccagucagcucauuaccucaacaaugacgggaaaauggcuucagucaagugcccuccuaagcaugagcucacugaggacugcaacuuuuguaggcagaugacaggugcuagcuugaaggaggggucuuauccucuccaagacuuauuuugucagucaagugaggaugauggaucaaaauuaaaaacaaaaaugaaaggggucugcgaaguggggguucaaguacucaaaaagugugauggccaacucagcacugcacaugaaguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguggcccacugccccccccaggacccgugccuagugcauggcugcauagugugugcucauggcuugauaaauuaccagugucacacugcuuucagugccuuuguuguuguguucguauucagcucuguugugauaauuuguuuggccauucuuuauaaggugcucaagugccuaaagauugccccaaggaaaguucugaauccacuaauguggaucacugccuucaucagauggguguauaagaagaugguugccagaguggcagacaauauuaaucaaguaaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaagugcaggcugucuggcacagcauuaaucagggcagggucaguuggggcagaggcuuguuugauguuaaagggggucaaggaagaccagaccaaguucuugaagauaaaaacugucucaagugagcuaucauguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugaacaguguggaggauggggauguggguguuucaaugugaacccaucuugcuuauuugugcacacguaucugcagucaguuagaaaagaagcccuuagaguuuuuaacuguauugauugggugcauaaacugacucuagagauuacagacuuugauggcucuguuucaacaguagacuugggagcaucaucuagccguuucacaaacugggguucagucagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcuuuuuuucuuucuuauauaucuuggaagaacaggucucucuaaaauguggcuugcugccacuaagaaagcuucauag

SEQ ID NO: 4493 - RNA, 3480 nt, Artificial Sequence
  derived and/or modified CDS sequence (wt) from RVFV(KEN/Gar-004/06)__HM586964.1__NSm-Gn-Gc
augauugaaggagcuugggauucacucagagaggaggagaugccagaggagcucuccugcucuguaucaggcauaagggagguuaagaccucaagccaggaguuauacagagcauuaaaagccaucauugcugcugauggcuugaacaacaucaccugccaugguaagaauccugaggacaagauuucucucauaaaggguccuccucacaaaaagcggguggggauaguccggugugagagacgaagagaugcuaagcaaauagggagagaaaccauggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucacagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagagaacuggggacgcagcauuuugcucugcuuaugaaugcacugcucaguaugccaaugccuauuguucacgugccaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauaaccagucacacucugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagauuacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4494 - RNA, 3204 nt, Artificial Sequence
  derived and/or modified CDS sequence (wt) from RVFV(ZH-548)__DQ380206.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4495 - RNA, 3204 nt, Artificial Sequence
  derived and/or modified CDS sequence (wt) from RVFV(2007000094)__EU574055.1__Gn-Gc
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4496 - RNA, 3204 nt, Artificial Sequence
  derived and/or modified CDS sequence (wt) from RVFV(ZH-548M12)__M25276.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4497 - RNA, 3204 nt, Artificial Sequence
  derived and/or modified CDS sequence (wt) from RVFV(Sudan 86-2010)__JQ820489.1__Gn-Gc
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacccuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcaaaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauaggguacucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuacugauugucucauaugcaucagcauguucagaacugauucaggcaaguuccagaaucaccacuugcuccacagagggugucaacaccaaguguagacugucuggcacagcauugaucagggcagggucaguuggggcggaggcuuguuugauguugaagggggucaaggaagaucaaaccaaguucuuaaagauaaaaacugucucaagugagcuaucgugcagggagggccagagcuauuggacuggguccuucagccccaagugccugagcucaaggagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguuaucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaaucugacagguugcuauucuugcaaugcaggggccagaguuugccugucuaucacauccacaggaacugggacucucucugcccacaauaaggacgggucucugcauauaguucucccaucagagaaugggacaaaagaucagugucagauacuacauuucaccguaccugaaguagaagaggaguuuauguacucuugugauggagaugagcggccucuguuagugaaagggacccugauagcuauugacccauuugaugauaggcgggaggcugggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4498 - RNA, 3204 nt, Artificial Sequence
  derived and/or modified CDS sequence (wt) from RVFV(ZS-6365)__DQ380205.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaagaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4499 - RNA, 3204 nt, Artificial Sequence
  derived and/or modified CDS sequence (wt) from RVFV(1853/78)__DQ380220.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguagacagaugacaggugcuagccuaaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccucgauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggguugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguguucaguucuauugcaauaauuuguuuagcuauucuuuauagggugcucaaaugcuuaaagauugccccaaggaaaguucugaauccacuaauguggauuacagccuucaucagauggguguauaagaagaugguugccagaguggcagacaauauuaaucaagugaacagggagauaggauggauggaaggaggucaguugguucuaggaaacccugccccuauuccucgucaugccccaauuccacguuauagcacauaccuaaugcuacuacuaauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguuccuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugccagauacuacacuucacuguaccugaaguagaggaggaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugcugcuacuaagaaggccucauag

SEQ ID NO: 4500 - RNA, 3204 nt, Artificial Sequence
  derived and/or modified CDS sequence (wt) from RVFV(T1)__DQ380201.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4501 - RNA, 3204 nt, Artificial Sequence
  derived and/or modified CDS sequence (wt) from RVFV(Kenya 83 (21445))__DQ380198.1__Gn-Gc
auggcagggauugcaaugacaguccuuccagccuuagcaguuuuugcuuuggcaccuguuguuuuugcugaagacccccaccucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacucgugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaaaaaggggucuuacccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucuguuucgagcauaagggacaguauaaaggaacaauggacucuggucagaccaagagggagcucaaaagcuuugauaucucucagugccccaagauuggagggcaugguaguaagaagugcacuggggacgcagcauucugcucugcuuaugagugcacugcucaguacgccaaugccuauuguucacaugcuaaugggucagggauugugcagauucaaguaucaggggucuggaagaagccuuuauguguaggguaugagagagugguugugaagagagaacucucugccaagcccauccagagaguugagccuugcacaacuugcauaaccaaaugugagccucauggauugguuguccgaucaacaggguucaagauaucaucugcaguugcuugugcuagcgggguuugcgucacaggaucgcagaguccuucuacugagauuacacucaaguauccagggauaucucaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagcuuucaucagauggguguauaagaagaugguugcuagaguggcagacaacauuaaucaagugaacagggaaauaggauggauggaaggaggucaguuggcucuagggaacccugccccuauuccucgucaugccccaaucccacguuauagcacauaccuaaugcuacuauugauugucucauaugcaucagcauguucagaacugauccaggcaagcuccagaaucaccacuugcuccacagagggugucaacaccaaguguagacugucuggcacagcauugaucagggcagggucaguuggggcagaggcuuguuugauguugaagggggucaaggaggaucaaaccaaauucuuaaagauaaaaacagucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucagguucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaccccuuuguugucuuugagagggguucucugccacagacaaggaaugacaaaaccuuugcagcuucaaaaggaaauagagguguucaggcuuucucuaagggcucuguacaagcugaucugacucugauguuugacaauuuugagguggacuuugugggagcagccgugucuugugaugccgccuucuugaauuugacagguugcuauucuuguaaugcaggggccagggucugccugucuaucacauccacaggaacuggaacucucucugcccacaauaaggaugggucucugcauauaguucucccaucagagaaugggacaaaagaucagugucagauacuacacuucacuguaccugaaguagaggaggaguuuauguacucuugugauggagaugagcggccucuguuagugaaagggacccugauagcuauugacccauuugaugauaggcgggaagcaggaggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugccgcuacuaagaaggccucauag

SEQ ID NO: 4502 - RNA, 3204 nt, Artificial Sequence
  derived and/or modified CDS sequence (wt) from RVFV(Sudan 85-2010)__JQ820488.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauugcccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucacagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucguauuuguauucaguucuauugcaauaauuugcuuagccauucuuuauagggugcucaagugcuuaaagauugccccaaggaaaguucugaauccacuaauguggauuacagccuucaucagauggguguauaagaagaugguugcuagaguggcagacaauauuaaucaagugaacagagaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaagaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaacaaguguuuugagcaguguggaggauggggguguggaugcuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacuggggcucaguuagccucucacuggacgcagagggcauuucaggcucaaauagcuuuucuuuuauugagagcccaggcaaaggguaugcaauuguugaugagccauucucagagaucccucggcaaggguucuugggggagauuagguguaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaacaaggacgggucucugcauauaguucucccaucagagaaugggacaaaagaucagugucagauacuacauuucacuguaccugaaguagaagaggaguucauguacucuugugauggagaugagcggccucuguuagugaaagggacccugauagcuauugacccauuugaugauaggcgggaagcagggggggaaucaacaguugugaauccaaaaucuggaucuuggaacuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4503 - RNA, 3204 nt, Artificial Sequence
  derived and/or modified CDS sequence (wt) from RVFV(2007004194)__EU574031.1__Gn-Gc
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucagcaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaagauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4504 - RNA, 3204 nt, Artificial Sequence
  derived and/or modified CDS sequence (wt) from RVFV(2250/74)__DQ380209.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaaaguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaguguggaggauggggguguggguguuuuaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccaaggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4505 - RNA, 3204 nt, Artificial Sequence
  derived and/or modified CDS sequence (wt) from RVFV(Sudan 28-2010)__JQ820491.1__Gn-Gc
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguagugaagagagaacucucagccaaacccauccagagaguugagccuugcacaacuugcauaaccaaaugugagccucauggauugguuguccgaucaacaggguucaagauaucgucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcucuacagagggugucaacaccaaguguagacugucuggcacagcauugaucagggcagggucaguuggggcggaggcuuguuugauguugaagggggucaaggaagaucaaaccaaguucuuaaagauaaaaacuguuucaagugagcuaucgugcagggagggccagagcuauuggacuggguccuuuagccccaagugccugagcucaagaagaugccaucuugucggagaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguuguauuaucaauugggcucuucuuccuccuuauauaucuuggaagaacaggccucucuaaaauguggcuugcugcuacuaagaaggccucauag

SEQ ID NO: 4506 - RNA, 3204 nt, Artificial Sequence
  derived and/or modified CDS sequence (wt) from RVFV(2007000324)__JF326195.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaagggaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4507 - RNA, 3204 nt, Artificial Sequence
  derived and/or modified CDS sequence (wt) from RVFV(ZM-657)__DQ380204.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaagccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuaguccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuucuccuuauauaucuuggaagaacaggccucucuaaaauguggcuugcugccacuaagaaggccucauag

SEQ ID NO: 4508 - RNA, 3204 nt, Artificial Sequence
  derived and/or modified CDS sequence (wt) from RVFV(T-46 (228113))__DQ380199.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaaaggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4509 - RNA, 3204 nt, Artificial Sequence
  derived and/or modified CDS sequence (wt) from RVFV(MP12)__Z30318.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccucauag

SEQ ID NO: 4510 - RNA, 3204 nt, Artificial Sequence
  derived and/or modified CDS sequence (wt) from RVFV(200803166)__JF311381.1__Gn-Gc
auggcagggauugcgaugacaguccuuccagcccuagcgguuuuugcuuuagcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuuaaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggauccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaacagcauguucagaacugauucaggcaagcuccagaaucaccacuugcuccacagagggugucaacaccaaguguagacugucuggcacagcauugaucagggcagggucaguuggggcagaggcuuguuugauguugaaggggguuaaggaagaucaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagucucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauguaguucucccaucagagaaugggacaaaagaucagugucagauacugcauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4511 - RNA, 3204 nt, Artificial Sequence
  derived and/or modified CDS sequence (wt) from RVFV(200803162)__JF311377.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaauaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauagccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuaaggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4512 - RNA, 3204 nt, Artificial Sequence
  derived and/or modified CDS sequence (wt) from RVFV(Hv-B375)__DQ380218.1__Gn-Gc
auggcagggauugcaaugacaguccuuccagccuuggcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagaaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguucaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucaugguuugguuguccgaucaacaggguucaagauaucaucugcaguugcuugugcuagcggaguuugcgucacaggaucacagagcccuucuaccgagauuacacucaaguauccagggauaucccaguccucugggggggacauagggguucacauggcacacgaugaucagucaguuagcuccaaaauaguagcucacugcccuccccaggacccaugcuuagugcacggcugcauagugugugcucauggccugauaaauuaccagugucacacugcccucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugcuccuauuccucgucaugccccaauuccacguuauagcacauaccuaaugcuacugcuaauugucucauaugcaucagcauguucagaacuaauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaaguacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaacucagaguccucaguccugagugcucaugaaucaugccuuagggcaccaaaccuuaucucauacaagcccaugauagaucaauuggagugcacaacaaaucugauugaucccuuuguuguauuugagagggguucucugccacagacaaggaaugacaaaaccuuugcagcuucaaaaggaaauagagguguucaagcuuucucuaagggcucugugcaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugaaguagaggaggaguuuauguacucuugugauggagaugagcggccucuauuagugaaagggacccugauagcuauugauccauuugaugauaggcgggaagcagggggagaaucaacaguugugaauccaaaaucuggaucuuggaauuucuuugacugguuuucuggacucaugaguugguuuggagggccucucaaaacuauacuccucauuugccuguauguugcauuaucaauugggcucuuuuuccuccucauauaucuuggaagaacagggcucucuaaaauguggcuugcugcuacuaagaaggccucauag

SEQ ID NO: 4513 - RNA, 3204 nt, Artificial Sequence
  derived and/or modified CDS sequence (wt) from RVFV(1260/78)__DQ380214.1__Gn-Gc
auggcagggauugcaaugacaguccuuccagccuuagcaguuuuugcucuagcaccuguuguuuuugcugaagacccccaucucagaaacagaccggggaaggggcacaacuacauugacgggaugacucaggaggaugccacaugcaaaccugugacauaugcuggggcauguagcaguuuugaugucuugcuugaaaaagggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggacgauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugcuuauuguucacaugcuaaugggucagggauugugcaaauacaaguaucaggggucuggaagaagccuuuauguguaggguaugagagagugguuguaaagagagaacucucugccaagcccauccagagaguugagccuugcacaacuuguauaaccaaaugugagccucauggauugguuguccgaucaacaggguucaaaauaucaucugcaguugcuugugcuagcggaguuugcgucacaggaucgcagaguccuuccaccgagauuacacucaaguauccagggauaucccaguccucugggggggacauagggguucacauggcacaugaugaccagucaguuagcuccaaaauaguagcucacugcccuccccaggacccgugcuuagugcauggcugcauagugugugcucauggccugauaaauuaccagugucacacugcucucagugccuuuguuguuguguuuguguucaguucuauugcaauaauuuguuuagcuauucuucauagggugcucaagugcuuaaagauugccccaaggaagguucugaauccacuaauguggauuacagccuucaucagauggguguauaagaagaugguugccagaguggcagacaauauuaaucaagugaacagggaaauaggauggauggaaggaggucaguugguucuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagcccuaaaugucugagcucaaggagaugccaucuugucggggaaugucaugugaauaggugucugucuuggagggacaaugaaacuucagcagaguuuucauuuguuggggaaagcacgaccaugcgggagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacacuagagaucacagacuuugauggcucuguuucaacaauagaccugggggcaucaucuagccguuucacaaacugggguucaguuagccucucacuggacgcagagggcauuucaggcucaaauagcuuuucuuucauugaaagcccaggcaaaggauaugcaauuguugaugagccauucucagaaauuccucgacaaggguuccugggggagaucaggugcaauucagaguccucaguccugagugcucaugaaucaugccuuagggcaccaaaccuuaucucauacaagcccaugauagaccaauuggagugcacaacgaaucugauugaucccuuuguugucuuugagagggguucucugccacagacaaggaaugacaaaaccuuugcagcuucaaaaggaaauagagguguccaagcuuucucuaagggcucuguacaagcugaucuaacucugauguuugacaauuuugagguggacuuugugggagcagccguaucuugugaugccgccuuccuaaauuugacagguugcuauucuugcaaugcaggggccagggucugccugucuaucacauccacaggaacuggaacccucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccucauauaucuuggaagaacaggccucucuaaaauguggcuugccgcuacuaagaaggccucauag

SEQ ID NO: 4514 - RNA, 3204 nt, Artificial Sequence
  derived and/or modified CDS sequence (wt) from RVFV(ZH-501-777)__DQ380202.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacccuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaaggggguaaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcaucucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugauaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 4515 - RNA, 3204 nt, Artificial Sequence
  derived and/or modified CDS sequence (wt) from RVFV(OS-3)__DQ380184.1__Gn-Gc
auggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4516 - RNA, 3204 nt, Artificial Sequence
  derived and/or modified CDS sequence (wt) from RVFV(SAUDI 200010901)__KU978778.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaagugggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4517 - RNA, 3204 nt, Artificial Sequence
  derived and/or modified CDS sequence (wt) from RVFV(2007001811)__EU574040.1__Gn-Gc
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucacgacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagcauguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaugauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccucauag

SEQ ID NO: 4518 - RNA, 3204 nt, Artificial Sequence
  derived and/or modified CDS sequence (wt) from RVFV(2007000253)__JF326192.1__Gn-Gc
auggcagggauugcgaugacaguccuuccagccuuagcaguuuuugcuuuggcaccaguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucagcuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4519 - RNA, 3204 nt, Artificial Sequence
  derived and/or modified CDS sequence (wt) from RVFV(2007001292)__EU574046.1__Gn-Gc
auggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggauccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaaucucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4520 - RNA, 3204 nt, Artificial Sequence
  derived and/or modified CDS sequence (wt) from RVFV(2007002476)__EU574036.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucaaauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4521 - RNA, 3204 nt, Artificial Sequence
  derived and/or modified CDS sequence (wt) from RVFV(73HB1230)__DQ380221.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccucccaaguaugagcucacugaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagacuaagaaggagcucaaaagcuuugauaucucucagugccccaagauuggaggacaugguaguaagaagugcacuggggacgcagcauuuugcucugcuuaugagugcacugcucaguacgccaaugccuauuguucgcaugcuaaugguucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcucaagugccuaaagauugcuccaaggaaaguucugaauccacuaauguggauuacagccuucaucagauggguguauaagaagaugguugcuagaguggcagacaauauuaaucaagugaacagggaaauaggauggauggaaggaggucaguugguccuagggaacccugccccuauuccucgucaugccccaaucccacguuauagcacauaccuaaugcuacuauugauugucucauaugcaucagcauguucagaacugauucaggcaagcuccagaaucaccacuugcuccacagaggguguuaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuuguuggagagugucaugugaauaggugucugucuuggagggacaaugaaacuucagcagaguuuucauuuguuggggaaagcacgaucaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacgacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuguuggugaaagggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugucuguauguugcauuaucaauugggcucuuuuuccuccuuauauaucuuggaagaacaggccucucuaaaauguggcuugcugcuacuaagaaggccucauag

SEQ ID NO: 4522 - RNA, 3204 nt, Artificial Sequence
  derived and/or modified CDS sequence (wt) from RVFV(ZINGA J83 R1)__KU978776.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcugaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4523 - RNA, 3204 nt, Artificial Sequence
  derived and/or modified CDS sequence (wt) from RVFV(2008/00101)__HE687306.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcauucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuacacuccucauuugccuguauguugcauuaucaauugggcucuucuuccuccuuauauaucuuggaagaacaggccucucuaaaauguggcuugccgcuacuaagaaggccucauag

SEQ ID NO: 4524 - RNA, 3204 nt, Artificial Sequence
  derived and/or modified CDS sequence (wt) from RVFV(2007002445)__EU574037.1__Gn-Gc
auggcagggauugcgaugacaguccuuccagccuuagcaguuuuugcuuuggcaccuguuguuuuugcugaagacccccaucucagaaacagaccagggaaggggcacaacuauauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuauacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4525 - RNA, 3204 nt, Artificial Sequence
  derived and/or modified CDS sequence (wt) from RVFV(ZC-3349)__DQ380207.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuacuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucaggcaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuuuaucagauggauauauaagaagaugguugccagaguggcagacaacauuaaucacgugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuaaggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccuaucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaaccauacuccucauuugccuguauguugcauuaucaauugggcucuuuuuccuccuuauauaucuuggaagaacaggccucucuaaaauguggcuugcugccacuaagaaggccucauag

SEQ ID NO: 4526 - RNA, 3204 nt, Artificial Sequence
  derived and/or modified CDS sequence (wt) from RVFV(Kenya 9800523)__DQ380196.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcacgguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugaaugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggaggggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4527 - RNA, 3204 nt, Artificial Sequence
  derived and/or modified CDS sequence (wt) from RVFV(Entebbe)__DQ380191.1__Gn-Gc
auggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugcuagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccaccugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugagacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugucugucuaucacaucuacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4528 - RNA, 3204 nt, Artificial Sequence
  derived and/or modified CDS sequence (wt) from RVFV(25010-24)__KM210509.1__Gn-Gc
auggcagggauugcaaugacaguccuuccagccuuagcaguuuuugcuuuggcaccuguugucuuugccgaagacccucaucuuagaaacaggccaggaaagggacacaacuacauugacgggaugacucaggaggaugccacauguaaaccugugacauaugcuggggcauguagcaguuuugaugucuugcucgaaaagggaaaauuuccccucuuccagucauacgcucaucauagaacucuacuagaggccguccacgacaccauuauugcaaaggcugauccaccuagcugugaccuucagagugcucaugggaaucccugcaugaaggagaaacucgugaugaagacacacuguccaaaugacuaccagucagcucauuaccuuaacaaugacgggaaaauggccucagucaagugcccuccuaaguaugagcucacugaggacugcaacuuuuguaggcagaugacaggugcuagccugaagaaagggucuuauccucuccaggacuuauuuugucagucaagugaggaugaugggucaaaauuaaaaacaaaaaugaaaggggucugcgaagugggaguucaagcacucaaaaagugugauggccaacucagcacugcacaugagguugugcccuuugcaguauuuaagaacucaaagaagguuuaucuugacaagcuugaccucaagacugaggaaaaucugcuaccagacucauuugucugcuucgagcauaaggggcaguauaaaggaacaauggacucuggucagacaaagagggagcucaaaagcuuugauaucucucagugucccaagauuggagggcaugguagcaagaaauguacuggggacgcagcauucugcucugcuuaugagugcacugcucaauacgccaaugccuauuguucacaugcuaaugggucaggaauuguacagauacaaguauccggggucuggaagaagccuuuguguguaggguaugagagagugguugugaagagagagcucucugccaagcccauccagagaguugagccuugcacaacuuguauaaccaaaugugagccucauggauuaauuguccgaucaacaggguucaagauaucaucugcaguugcuugugcuagcggaguuugcgucacaggaucgcagagcccgucuacugagaucacacucaaguacccagggauaucccaguccucugggggggacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuugucguuguguucguguucagcucuguugcaauaauuuguuuggcuauucuuuauaaggugcucaagugccuaaaaauugccccaaagaaaguucuaaauccacugauguggauuacugcuuucaucagauggguguauaagaagaugguugccagaguggcagacaauaucaaucaagugaacagggaaauaggauggauggaaggaggccaguuagcucuagggaauccugcuccuaucccucgucaugcuccaauuccacguuauagcacauaccuaaugcuacuauugauugucucauaugcaucagcauguucagaacugauucaggccagcuccagaaucacuacuugcuccacagaagguguuaacacuaaguguaggcugucuggcacagcauugaucagggcaggaucaguuggagcagaagcuugucugauguuaaagggggucaaggaugaccaaaccaaguuccugaagauaaaaacugucucaagugagcuaucgugcagggagggccagagcuauuggacuggguccuucagccccaaaugucugagcucaaggaggugccaucuugucggggaaugucaugugaauaggugucugucuuggagggacaaugagacuucagcagaauuuucauuuguuggggaaagcacgaccaugcgagagaacaaguguuuugagcaguguggaggauggggauguggguguuucaacguaaacccaucuugcuuguuugugcacacguaucuacagucagucagaaaagaggcccuuagaguuuuuaacugcauugauugggugcauaaacuuacucuagagaucacagacuuugauggcucuguuucaacaauagacuugggagcuucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggauucuuaggagagaucaggugcaauucagaaucuucaguucugagugcucaugaaucaugccuuagggcgccaaaccuuaucucauacaaaccaaugauagaucaguuggagugcacaacaaaucuaauugauccuuuuguagucuuugagagggguucccugccacaaacaaggaaugacaaaaccuuugcagcuucaaaagggaauagggguguucaagcuuucucuaagggcucuguacaagcugaucuaacucugauguuugacaauuuugagguggacuucgugggagcagccgugucuugugaugccgccuucuugaauuugacagguugcuauucaugcaaugcaggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaagggacccugauagcuauugauccauuugaugauaggcgagaagcagggggggaaucaacaguugugaauccaaaaucuggaucuuggaauuucuuugacugguuuucuggacucaugaguugguuuggagggccucucaagacuauacuccuaauuugccuguauguagcauuaucaauugggcucuuuuuccuucuuauauaucuugggagaacaggucucucuaaaauguggcuugcugcuacuaagaaggccucauag

SEQ ID NO: 4529 - RNA, 3204 nt, Artificial Sequence
  derived and/or modified CDS sequence (wt) from RVFV(763/70)__DQ380188.1__Gn-Gc
auggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugggcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagaucacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagcuggcucuagggaacccugccccuauuccucgucaugcuccaauuccacguuauagcacauacuuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugacggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4530 - RNA, 3204 nt, Artificial Sequence
  derived and/or modified CDS sequence (wt) from RVFV(OS-1)__DQ380186.1__Gn-Gc
auggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugcccuccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcucuacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuaaaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4531 - RNA, 3204 nt, Artificial Sequence
  derived and/or modified CDS sequence (wt) from RVFV(BIME-01)__KX609032.1__Gn-Gc
auggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4532 - RNA, 3204 nt, Artificial Sequence
  derived and/or modified CDS sequence (wt) from RVFV(73HB1449)__DQ380211.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4533 - RNA, 3204 nt, Artificial Sequence
  derived and/or modified CDS sequence (wt) from RVFV(SA01-1322)__KX096942.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguaggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuaggggacccugccccuauuccucgucaugccccaaucccacguuauagcacauaccuaaugcugcuauugauuaucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccagguaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacuuaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4534 - RNA, 3204 nt, Artificial Sequence
  derived and/or modified CDS sequence (wt) from RVFV(Sudan 2V-2007)__JQ820490.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaaugacuaccagucagcucauuaccucaacaaugacgggaaaauggccucagucaagugcccaccuaaguaugagcucacugaggacugcaacuuuuguagacagaugacaggugcuagccugaagaaggggucuuauccucuccaagacuuauuuugucagucgagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaaggucuaucuugauaagcuugaccucaagacugaggagaaucugcuaccagacucauuugucugcuucgagcauaagggacaguauaaaggaacaauggacucuggucagaccaagagggagcucaagagcuuugauaucucucagugccccaagauuggagggcaugguaguaagaagugcacuggggaugcagcauuuugcucugcuuaugaaugcacugcucaguaugccaaugccuauuguucacaugcuaaugggucagggauugugcagauucaaguaucaggggucuggaagaaaccuuuguguguaggguaugagagagugguugugaagagagaacucucugccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggauauagggguucacauggcacacgaugaucagucaguuagcuccaaaauaguagcucacugccccccccaggacccgugcucagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuauugauugucucacaugcaucagcauguucagaacuuauucaggcaagcuccagaaucaccacuugcuccacagagggugucaacaccaaguguagacugucuggcacagcauugaucagggcagggucaguuggggcggaggcuuguuugauguugaagggggucaaggaagaucaaacuaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaauguaaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguuuuugggggagaucaggugcaauucagaguccucaguccuaagugcucaugaaucaugccuuagggcgccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaagacgggucucugcauauaguucucccaucagagaaugggacaaaagaucagugucagauacuacauuuuacuguaccugaaguagaagaggaguuuauguacucuugugauggagaugagcggccucuguuaguaaaagggacccugauggcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4535 - RNA, 3204 nt, Artificial Sequence
  derived and/or modified CDS sequence (wt) from RVFV(35/74)__JF784387.1__Gn-Gc
auggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucuggauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4536 - RNA, 3204 nt, Artificial Sequence
  derived and/or modified CDS sequence (wt) from RVFV(200803169)__JF311384.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaagguagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagauuccucggcaaggguucuugggggaggucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4537 - RNA, 3204 nt, Artificial Sequence
  derived and/or modified CDS sequence (wt) from RVFV(2269/74)__DQ380222.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacauguaaaccugugacauaugcuggggcauguagcaguuuugaugucuugcucgaaaaggggaaauucccccucuuccagucguaugcucaucauagaacucuacuagaggcaguucacgacacuaucauugcaaaggcugacccaccuagcugugaccuucagagugcucaugggaaucccugcaugaaagagaagcucgugaugaagacacacuguccaaaugacuaccaaucagcucauuaccuuaacaaugacgggaaaauggcuucagucaagugccccccuaaguaugagcucacugaggauugcaacuuuuguaggcagaugacaggugcuagccugaagaaggggucuuauccucuccaggacuuauuuugucagucaagugaggaugaugggucaaaauuaaaaacaaaaaugaaaggggucugcgaagugggaguucaagcacuaaaaaagugugauggccaacucagcacugcacaugagguugugcccuucgcaguguuuaagaacucaaagaagguuuaucuugauaagcuugaccuuaagacugaggaaaaucugcuaccagacucauuugucugcuucgagcauaaaggacaacauaaaggaacaauggacucuggucagaccaagagggagcucaaaagcuuugauaucucucagugccccaagauuggaggacaugguagcaagaagugcacuggggacgcagcauuuugcucugcuuaugagugcacugcucaguacgccaaugccuauuguucacaugcuaaugggucaggaauugugcagauacaagugucaggggucuggaagaagccuuuauguguaggguaugagagagugguuguaaagagagaacucucugccaagcccauccagagaguugagccuugcacaacuuguauaaccaaaugcgagccucauggacugguuguccgaucaacaggguucaagauaucaucugcaguugcuugugcuagcggaguuugcgucacaggaucgcagaguccuucuaccgagauuacacucaaguauccaggaauaucucaguccucugggggggacauagggguucacauggcacacgacgaucagucaguuagcuccaaaauaguagcucacugccccccccaggacccgugcuuagugcauggcugcauagugugugcucauggccugauaaauuaccagugucacacugcucucagugccuuuguuguuguguucguguucagcucuguugcaauaauuuguuuggccauucuuuauaaggugcucaagugccuaaagauugccccaaagaaaguucugaauccgcuaauguggauuacugccuucaucagauggguauauaagaagaugguugccagaguggcagauaauauaaaucaagugaacagggaaauaggauggauggaaggaggucaguuggcucuagggaacccugccccuauuccucgucacgcuccaaucccacgcuauagcacauaccuaaugcuacuacugauugucucauaugcgucagcauguucagaacugauucaggcaagcucuaggauuaccacuugcuccacagaaggugucaacaccaaguguaggcugucuggcacagcauuaauuagggcagggucaguuggggcagaggcuuguuugauguuaaagggggucaaggaagaccaaaccaaguucuugaagauaaaaacugucucaagugagcuaucgugcagggagggccagagcuacuggacuggguccuuuagccccaaaugucugagcucaaggagaugccaucuugucggggaaugucaugugaauaggugcuugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaccugcagucaguuagaaaagaggcccuuagaguuuuuaacuguaucgauugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucauucauugagagcccaggcaaaggguaugcaauuguugaugagccauucucagaaauuccucggcaaggguuccugggggagaucaggugcaacucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaagaaaugacaaaacuuuugcagcuucaaaaggaaauagggguguucaagcuuucucuaagggcucugugcaagcugaucuaacucugauguuugacaauuuugagguggacuuugugggagcagccgugucuugugaugccgccuucuuaaauuugacagguugcuauucuugcaaugcaggggccagggucugccugucuaucacauccacaggaacuggaacucucucugcccacaacaaggaugggucucugcauauaguucucccaucagaaaauggaacaaaagaucagugucagauacuacacuucacugugccugagguagaggaggaguuuauguacucuugugauggagaugagcggccuuuguuagugaaggggacccugauagccauugauccauuugaugauaggcgggaagcaggaggggaaucaacaguugugaauccaaaaucuggaucuuggaauuucuuugacugguucucuggacucaugaguugguuuggagggccucuuaagaccauacuccucauaugccuguauguugcauuaucaauugggcucuuuuuccuucuuauauaucuuggaagaacaggucucucuaaaauguggcuugcugcuacuaagaaggcuucauag

SEQ ID NO: 4538 - RNA, 3204 nt, Artificial Sequence
  derived and/or modified CDS sequence (wt) from RVFV(SA-51 (Van Wyck))__DQ380195.1__Gn-Gc
auggcagggauugcaaugacaguccuuccagccuuagcaguuuuugcuuuggcaccuguuguuuuugcugaagacccccaucucagaaacagaccagggaagggacacaacuacauugacgggaugacucaggaggaugccacauguaaaccugugacauaugcuggggcauguagcaguuuugaugucuugcucgaaaagggaaaauuuccccuuuuucagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaacgacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggaaaaucugcuaccagacucauuugucugcuucgagcauaagggacaguauaaaggaacaauggacucuggucagacuaagagggagcucaagagcuuugauaucucucagugccccaagauuggaggacgugguagcaagaagugcacuggggacgcagcauuuugcucugcuuaugagugcacugcucaauacgccaaugccuauuguucacaugcuaaugggucaggaauugugcagauacaaguaucaggggucuggaagaagccuuuauguguaggauaugagagagugguugugaaaagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacagagauuacacucaaguacccagggauaucccaguccucuggaggggacauagggguucacauggcacacgaugaucagucaguuagcuccaaaauaguagcucacugccccccccaagacccgugcuuagugcauggcugcauagugugugcucauggccugauaaauuaccagugucacacugcucucagugccuuuguuguuguguucguauucagcucuguugcaauaaucuguuuagccauucuuuauaaggugcucaagugccuaaagauugccccaaggaaaguucugaauccacuaauguggauuacugccuucaucagauggguguauaagaagaugguugccagaguggcagacaauauuaaucaagugaacagggagauaggauggauggaaggaggucaguuggcucuagggaauccugccccuauuccucgucaugcuccaauuccacguuauagcacauaccuaaugcuacuauugauugucucauaugcaucagcaugcucagaacugauucaggcaagcuccagaaucaccacuugcucuacagaaggugucaacaccaaguguaggcugucuggcacagcauuaaucagggcagggucaguuggggcagaggcuuguuugauguugaagggggucaaggaagaccaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggauaaugaaacuucagcagaguuuucauuuguuggggaaagcacgaccaugcgagaaaauaaguguuuugagcaguguggaggauggggauguggguguuucaaugugaacccaucuugcuuauuugugcacacguaucugcagucaguuagaaaagaggcccuuagaguuuuuaacuguaucgauugggugcauaaacucacucuggaggucacagauuuugauggcucuguuucaacaauagacuugggagcaucaucuagccguuucacaaacugggguucaguuagccucucacuggaugcagagggcauuucaggcucaaauagcuuuucuuucauugagagcccaggcaaaggguaugcaauuguugaugagccauucucagaaauuccucggcaaggguucuugggggagaucaggugcaauucagaaucuucaguucugagugcccacgaaucaugccuuagggcaccaaaccuuaucucauacaagcccaugauagaucaguuggagugcacaacaaaucugauugaucccuuuguugucuuugagagggguucccugccacagacaaggaaugacaaaaccuuugcagcuucaaaaggaaacagggguguucaagcuuucucuaagggcucuguacaagcugaucuaacucugauguuugacaauuuugagguggacuuugugggagcagccgugucuugugaugcugccuucuuaaauuugacagggugcuauucuugcaaugcaggggccagggucugccugucuaucacauccacaggaacuggaacccucucugcccacaauaaggaugggucucugcauauaguucuuccaucagagaauggaacaaaagaucagugucagauacuacacuucacuguuccugaaguagaggaagaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuucuuauauaucuuggaagaacaggucuuucuaaaauguggcuugcugcuacuaagaaggccucauag

SEQ ID NO: 4539 - RNA, 3204 nt, Artificial Sequence
  derived and/or modified CDS sequence (wt) from RVFV(OS-8)__DQ380185.1__Gn-Gc
auggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauacgcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugccccccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagcauguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaggauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugucagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccucauaa

SEQ ID NO: 4540 - RNA, 3204 nt, Artificial Sequence
  derived and/or modified CDS sequence (wt) from RVFV(KEN07-KUR340)__EF460404.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauaggaugcucaagugcuuaaagauugccccaaggauaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucgucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4541 - RNA, 3204 nt, Artificial Sequence
  derived and/or modified CDS sequence (wt) from RVFV(ANK-3837)__DQ380215.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4542 - RNA, 3204 nt, Artificial Sequence
  derived and/or modified CDS sequence (wt) from RVFV(Lunyo)__KU167026.1__Gn-Gc
auggcagggauugcaaugacaguccuuccagccuuagcaguuuuugcuuuggcaccuguuguuuuugcugaagacccucaucucagaaauagaccagggaaggggcacaacuacauugacgggaugacucaggaggaugccacauguaaaccugugacauaugcuggggcauguagcaguuuugaugucuugcuugaaaagggaaaauuuccccucuuccagucguaugcucaucauagaacucuacuggaggcaguucaugacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguaggcagaugacaggugcuagcuugaagaaggggucuuauccccuccaggaccuauuuugucagucaagugaggaugauggaucaaaauuaaaaacaaaaaugaaaggggucugcgaaguugggguucaagcacucaaaaagugugauggccaacucagcacugcacaugagguugugcccuuugcaguguuuaagaacucaaagaagguuuaucuugauaagcuugaccucaagacugaggaaaaucugcuaccagacucauuugucugcuucgagcacaagggacaguauaaaggaacaauggucucuggucagacuaagagggagcucaaaagcuuugauaucucucagugucccaagauuggaggacaugguagcaagaagugcacuggggacgcagcauuuugcucugcuuaugagugcacugcucaauaugccaaugccuauugcucacaugcuaauggaucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccggucaacaggguucaagauaucaucugcaguugcuugugcuagcggaguuugcgucacaggaucgcagaguccuucuaccgagauuacacucaaguauccagggauaucccaguccucugggggggacauagggguucacauggcacaugaugaucagucaguuaguuccaaaauaguagcucacugcccuccccaggacccgugccuagugcauggcugcauagugugugcucauggccugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggucaguuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccagguguaggcugucuggcacagcauuaaucagggcagggucaguuggggcagaggcuuguuugauguuaaagggggucaaggaagaccaaaccaaguucuugaagauaaaaacugucucaagugagcuaucgugcagggagggccagagcuauuggacuggauccuuuagccccaaaugucugagcucaaggagaugccaucuugucggggaaugucaugugaauaggugucugucuuggagggacaaugaaacuucagcagaauuuucauuuguuggggaaagcacgacuaugcgagagaauaaauguuuugagcaguguggaggauggggauguggguguuucaaugugaacccaucuugcuuauuugugcacacguaucugcagucaguuagaaaagaggcccuuagaguuuucaacuguaucgauugggugcauaaacucacucuagagauuacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaauuugauugaucccuuuguugucuuugagagggguucucuaccacagacaaggaaugacaaaaccuuugcagcuucaaaaggaaauagggguguucaagcuuucucuaagggcucuguacaagcugaccuaacucugauguuugacaauuuugagguggacuuugugggggcagccgugucuugugaugccgccuucuuaaauuugacagguugcuauuccugcaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacucaugaguugguuuggagggccccuuaagacuauacuccuuauuugccuguauguagcauuaucaauugggcucuuuuuccuucuuauauaucuuggaagaacaggucucucuaaaauguggcuugcugccacuaagaaagccucauag

SEQ ID NO: 4543 - RNA, 3204 nt, Artificial Sequence
  derived and/or modified CDS sequence (wt) from RVFV(200803167)__JF311382.1__Gn-Gc
auggcagggauugcgaugacaguccuuccagccuuagcaguuuuugcuuuggcaccuguuguuuuugcugaagaccuccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauugcacucaaguauccagggauaucccaguccucugggggggauauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaagggggucaguugguucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuucgagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuaugcuccucauuugccuguauguugcauuaucaauugggcucuucuuccuccuuauauaucuuggaagaacaggccucucuaaaauguggcuugccgcuacuaagaaggccucauag

SEQ ID NO: 4544 - RNA, 3204 nt, Artificial Sequence
  derived and/or modified CDS sequence (wt) from RVFV(2373/74)__DQ380194.1__Gn-Gc
auggcagggauugcaaugacaguccuuccagccuuagcaguuuuugcuuuggcaccuguuguuuuugcugaagacccucaucucagaaacagaccagggaaggggcacaacuacauugacgggaugacucaggaggaugccacauguaaaccugugacauaugcuggggcauguagcaguuuugaugucuugcucgaaaagggaaaauucccccucuuccagucauaugcucaucauagaacucuacuagaggcaguucacgacaccaucauugcaaaggcugacccaccuagcugugaccuccagagugcucaugggaaucccugcaugaaagagaaacucgugaugaagacacacugcccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaggacuuguucugucaaucaagugaggaugauggaucaaaauuaaaaacaaaaaugaaaggggucugcgaaguggggguucaagcacucaaaaagugugauggccaacucagcacugcacaugagguugugccauuugcaguguuuaaaaacucaaagaagguuuaucuugacaagcuugaccucaagacugaggaaaaucugcuaccagacucauuugucugcuucgagcauaagggacaguauaaagggacaauggacucuggucagacuaagagggagcucaaaaguuuugauaucucucagugccccaagauuggaggacaugguagcaagaagugcacuggggacgcagcauuuugcucugcuuaugagugcacugcucaauacgccaaugccuauuguucacaugcuaaugggucaggaauuguacagauacaaguauccggggucuggaagaagccuuuauguguaggauaugagagagugguugugaagagagaacucucugcuaagcccauccagagaguugagccuugcacaacuuguauaaccaaaugcgagccucauggguugguuguccgaucaacaggguucaagauaucuucugcaguugcuugugcuagcggaguuugcgucacaggaucacagagcccuucuaccgagauuacacucaaguauccaggaauaucccaguccucugggggggacauagggguucacauggcacaugaugaucagucaguuagcuccaaaaugguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagguggguguauaagaagaugguugccagaguggcagacaauaucaaucaagugaacagggaaauaggauggauggaaggaggccaguuggcucuagggaacccugccccuauuccucgucaugccccaauuccacguuauagcacauaccuaaugcuacuauugauugucucauaugcaucagcauguucagaacugauucaggcaagcuccagaaucaccaccugcuccacagaaggugucaacaccaaguguaggcugucuggcacagcauuaaucagggcagggucaguuggggcagaggcuuguuugauguuaaagggggucaaagaagaccaaaccaaguucuugaagauaaaaacugucucaagugagcuaucgugcagggaaggccagagcuauuggacuggguccuuuagccccaaaugccugagcucaaggaggugccaucuugucggggaaugucaugugaauaggugucugucuuggagggacaaugaaacuucugcagaauuuucauuuguuggggaaagcacgaccaugcgagagaauaaguguuuugagcaguguggaggauggggauguggguguuucaaugugaauccaucuugcuuauuugugcacacguaucugcagucgguuagaaaagaggcccuuagaguuuucaacuguauugauugggugcauaaacucacucuagagaucacagacuuugauggcucuguuucaacauuagacuugggagcaucaucuagccguuucacaaacugggguucgguuagccucucacuggaugcagagggcauuucaggcucaaauagcuuuucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaaggaaugaaaaaaccuuugcagcuucaaaaggaaauagggguguucaagcuuucuccaagggcucuguacaagcugaucuuacucugauguuugacaauuuugagguggacuuugugggagcagccgugucuugugaugccgccuucuuaaauuuaacagguugcuauuccugcaaugcaggagccagagucugcuugucuaucacauccacaggaacuggaacucucucugcccacaauaaggaugggucucugcacauaguucuuccaucagagaauggaacaaaagaucagugucagauacuacacuucacuguaccugagguggaggaggaguuuauguacucuugugauggagaugagcggccucuauuggugaaggggacccugauagcuauugauccauuugaugauaggcgagaagcaggaggggaaucaacaguugugaauccaaaaucugguucuuggaauuucuuugacugguuuucuggacuuaugaguugguuuggagggccucuuaagaccauacuccuaauuugccuguauguggcauuaucaauugggcucuuuuuccuccuuauauaucuuggaagaacaggucucucuaaaauguggcuugcugccacuaagaaagccucauag

SEQ ID NO: 4545 - RNA, 3204 nt, Artificial Sequence
  derived and/or modified CDS sequence (wt) from RVFV(Kenya 57 (Rintoul))__DQ380192.1__Gn-Gc
auggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuucucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuucauag

SEQ ID NO: 4546 - RNA, 3204 nt, Artificial Sequence
  derived and/or modified CDS sequence (wt) from RVFV(RVFBJ01/2016)__KX785331.1__Gn-Gc
auggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaagcaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcacccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4547 - RNA, 3204 nt, Artificial Sequence
  derived and/or modified CDS sequence (wt) from RVFV(clone 13)__DQ380213.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagcaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccucauag

SEQ ID NO: 4548 - RNA, 3204 nt, Artificial Sequence
  derived and/or modified CDS sequence (wt) from RVFV__JQ068143.1__Gn-Gc
auggcagggauugcaaugacaguccuucccgccuuagcaguuuuugcuuuggcaccuguuguuuuugcugaggacccucaucucagaaacagaccagggaagggacacaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugacccaccuagcugugaucuucagagugcucaugggaaccccugcaugaaagagaaacucgugaugaagacacacuguccaaaugacuaccagucagcucauuaucucaacaaugacgggaaaauggcuucagucaagugcccuccuaaguaugagcucacugaggacugcaacuuuuguaggcagaugacaggugcuagcuugaagaaggggucuuauccucuccaggacuuauuuugucagucaagugaggaugaugggucaaaauuaaagacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaagaaaaucugcuaccagacucauuugucugcuuugagcauaaaggacaguauaaaggaacaauagacucuggucagacuaagagagagcucaaaagcuuugauaucucucagugccccaagauuggaggacaugguagcaagaagugcacuggggacgcagcauuuugcucugcuuaugaguguacugcucaguaugccaaugccuauuguucacaugcuaaugggucugggauuguacagauacaaguguccggggucuggaagaagccucuguguguaggauaugagagagugguugugaagagagaacucucugccaagcccauccagagaguugagccuugcacaacuugcauaaccaaaugugagccucauggauugguuguccgaucaacaggguuuaagauaucaucugcaguugcuugugcuagcgggguuugcgucacaggaucgcagagcccuucuacugagaucacucuuaaguauccagggauaucccaauccucugggggggacauaggaguucacauggcacaugaugaucagucaguuagcuccaaaauaguggcucacugccccccccaggacccgugccuagugcauggcugcauagugugugcucauggcuugauaaauuaccagugucacacugcucucagugcuuuuguuguuguauucguauucagcucuguugcaauaauuugucuggccauccuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcuccuauuccucgucaugcuccaauuccacguuauagcacguaucuaaugcuacuauugauuaucucauaugcaucagcauguucagaacugauucaggcaagcuccagaaucacuacuugcuccacagaaggugucaacaccaaguguaggcugucuggcacagcauuaaucagggcagggucaguuggggcagaggcuuguuuaauguuaaagggggucaaggaagaccagaccaaguucuugaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaaccucagcagaauuuucauuuguuggggaaagcacgaccaugcgagagaauaaguguuuugagcaguguggaggauggggauguggauguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaauagacuugggggcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggagagaucaggugcaauucagaaucuucuguccugagugcucaugaaucaugccuuagggcuccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaagggcucuguacaagcugaucuaacucugauguuugacaauuuugagguggacuuugugggggcagccgugucuugugaugccgccuucuuaaauuugacagguugcuauuccugcaaugcuggagccagagucugccugucuaucacauccacaggaacuggaacucuuucugcccacaauaaggaugggucucugcacauaguucuuccaucagagaauggaacaaaagaucagugucagauacuacacuucacuguaccugagguggaggaggaguuuauguacucuugugauggagaugagcggccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucucggaagaacaggucucucuaaaauguggcuugcugccacuaagaaagccucauag

SEQ ID NO: 4549 - RNA, 3204 nt, Artificial Sequence
  derived and/or modified CDS sequence (wt) from RVFV(SA-75)__DQ380189.1__Gn-Gc
auggcaaggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaccccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccucauag

SEQ ID NO: 4550 - RNA, 3204 nt, Artificial Sequence
  derived and/or modified CDS sequence (wt) from RVFV(ANK-6087)__DQ380216.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagcauguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaaaauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcucaacaaaucugauugaccccuuuguuguauuuaagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccucauag

SEQ ID NO: 4551 - RNA, 3204 nt, Artificial Sequence
  derived and/or modified CDS sequence (wt) from RVFV(KEN/Kil-006/07)__HM586966.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgccacuaagaaggccucauag

SEQ ID NO: 4552 - RNA, 3204 nt, Artificial Sequence
  derived and/or modified CDS sequence (wt) from RVFV(MgH824)__DQ380210.1__Gn-Gc
auggcagggauugcaaugacaguccuuccagccuuagcaguuuuugcuuuggcaccuguuguuuuugcugaagacccccaucucagaaacagaccagggaagggguacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugacccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcguaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacuacucaguacgccaaugccuauuguucacaugcuaaugggucagggguugugcagauacaagugucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagcauguucagaacugauucaggcaagcuccagaaucaccacuugcucuacagaggguguugacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacuggguacauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucccagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaccccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacauuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaaggacaggccucucuaaaauguggcuugcugccacuaagaaggccucauag

SEQ ID NO: 4553 - RNA, 3204 nt, Artificial Sequence
  derived and/or modified CDS sequence (wt) from RVFV(KEN/Mal-032/07)__HM586967.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4554 - RNA, 3204 nt, Artificial Sequence
  derived and/or modified CDS sequence (wt) from RVFV(Kenya 56 (IB8))__DQ380190.1__Gn-Gc
auggcagggauugcaaugacaguccuuccagccuuagcaguuuuugcuuuggcaccuguuguuuuugcugaagacccucaucucagaaacagaccagggaaggggcacaacuacauugacgggaugacucagggggaugccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaauccuugcaugaaggagaaacucgugaugaagacacacuguccaaaagacuaccagucagcucauuaccucaacaaugacgggaaaauggcuucagucaagugcccuccuaaauaugagcucacugaggacugcaauuuuugcaggcagaugacaggugccagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcuaaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaggccuuuguguguaggguaugagagggugguugugaagagagaacucucugcuaagcccauccagagaguugagccuugcacaacuuguauaaccaaaugugagccucauggauugguuguccgaucaacagguuucaagauaucaucugcaguugcuugugcuagcggaguuugcguuacaggaucgcagagcccuucuaccgagauuacacucaaguauccagggaugucccaguccucugggggggacauagggguucauauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagccggcucuagggaacccugccccuauuccucgucaugcuccaauuccacguuauagcacauaccuaaugcuacuauugauugucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagagagggccagagcuauuggacuggguccuuuagcccuaaaugucugagcucaaggaggugccaucuugucggggaaugucaugugaauaggugucugucuuggagagacaaugaaacuucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaaucugauugaucccuuuguugccuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuccuuauauaucuuggaagaacaggccucucuaaaauguggcuugcugccaccaagaaagccucauag

SEQ ID NO: 4555 - RNA, 3204 nt, Artificial Sequence
  derived and/or modified CDS sequence (wt) from RVFV(KEN/Gar-008/06)__HM586965.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuugaagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguaaaagaggaguucauguacucuugugauggagaugagcgggcucuguuaaugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4556 - RNA, 3204 nt, Artificial Sequence
  derived and/or modified CDS sequence (wt) from RVFV(KEN/Bar-035/07)__HM586969.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugacgguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcacggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4557 - RNA, 3204 nt, Artificial Sequence
  derived and/or modified CDS sequence (wt) from RVFV(Smithburn)__DQ380193.1__Gn-Gc
auggcagggauugcaaugacagucuuuccagccuuaguaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaucaucauugcaaaggcugauccaccuagcuguaaccuucagagugcucaugggaaucccugcaugaaagagaaacucguaaugaagacauacuguccaaaugacuaccagucagcucauuaccucaacaaugacgggaaaauggcuucagucaagugcccuccuaagcaugagcucacugaggacugcaacuuuuguaggcagaugacaggugcuagcuugaaggaggggucuuauccucuccaagacuuauuuugucagucaagugaggaugauggaucaaaauuaaaaacaaaaaugaaaggggucugcgaaguggggguucaaguacucaaaaagugugauggccaacucagcacugcacaugaaguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguggcccacugccccccccaggacccgugccuagugcauggcugcauagugugugcucauggcuugauaaauuaccagugucacacugcuuucagugccuuuguuguuguguucguauucagcucuguugugauaauuuguuuggccauucuuuauaaggugcucaagugccuaaagauugccccaaggaaaguucugaauccacuaauguggaucacugccuucaucagauggguguauaagaagaugguugccagaguggcagacaauauuaaucaaguaaacagggaaauaggauggauggaaggaggccaguugguucuagggaacccugccccuauuccucgucaugcuccaauuccacguuauagcacauaccuaaugcugcuauugauugucucauaugcaucagcauguucagaacuaauucaggcaagcuccagaaucaccacuugcuccacagaaggugucaacaccaagugcaggcugucuggcacagcauuaaucagggcagggucaguuggggcagaggcuuguuugauguuaaagggggucaaggaagaccagaccaaguucuugaagauaaaaacugucucaagugagcuaucauguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugaacaguguggaggauggggauguggguguuucaaugugaacccaucuugcuuauuugugcacacguaucugcagucaguuagaaaagaagcccuuagaguuuuuaacuguauugauugggugcauaaacugacucuagagauuacagacuuugauggcucuguuucaacaguagacuugggagcaucaucuagccguuucacaaacugggguucagucagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcuuuuuuucuuucuuauauaucuuggaagaacaggucucucuaaaauguggcuugcugccacuaagaaagcuucauag

SEQ ID NO: 4558 - RNA, 3204 nt, Artificial Sequence
  derived and/or modified CDS sequence (wt) from RVFV(Beijing-01)__KX611606.1__Gn-Gc
auggcagggauugcaaugacaguucuucccgccuuagcaguuuuugcuuuggcaccuguuguuuuugcugaggacccucaucucagaaacagaccagggaagggacauaacuacauugacggggugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaagcacucaaaaagugugauggccgacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauagucuuugacugcccuccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagcauguucagaacugauucaggcaagcuccagaaucaccacuugcuccacagaaggugucaacaccaaguguaggcugucuggcacagcauuaaucagggcagggucaguuggggcagaggcuuguuugauguuugagggggucaaggaagaccagaccaaguucuuaaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccucauag

SEQ ID NO: 4559 - RNA, 3204 nt, Artificial Sequence
  derived and/or modified CDS sequence (wt) from RVFV(KEN/Bar-032/07)__HM586968.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaaaugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugugggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucucacacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4560 - RNA, 3204 nt, Artificial Sequence
  derived and/or modified CDS sequence (wt) from RVFV(TAN/Dod-002/07)__HM586971.1__Gn-Gc
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguccaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucaggccuggauaaucucucaguggcacacggcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4561 - RNA, 3204 nt, Artificial Sequence
  derived and/or modified CDS sequence (wt) from RVFV(KEN/Gar-004/06)__HM586964.1__Gn-Gc
auggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucacagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagagaacuggggacgcagcauuuugcucugcuuaugaaugcacugcucaguaugccaaugccuauuguucacgugccaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauaaccagucacacucugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagcauguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagauuacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccucauag

SEQ ID NO: 4562 - RNA, 1680 nt, Artificial Sequence
  derived and/or modified CDS sequence (wt) from RVFV(ZH-548)__DQ380206.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4563 - RNA, 1680 nt, Artificial Sequence
  derived and/or modified CDS sequence (wt) from RVFV(MP-12)__DQ380208.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4564 - RNA, 1680 nt, Artificial Sequence
  derived and/or modified CDS sequence (wt) from RVFV(MP12)__Z30318.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucaucaccucaacaaugacgggaaaauggcuucagucaagugcccuccuaaguaugagcucacugaagacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4565 - RNA, 1680 nt, Artificial Sequence
  derived and/or modified CDS sequence (wt) from RVFV(2007001811)__EU574040.1__Gn
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucacgacaccaucauugcaaaggcugauccaccuagcugugaccuccagagugcucaugggaaucccuguaugaaagagaaacuugugaugaagacacauuguccuaacgacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagca

SEQ ID NO: 4566 - RNA, 1680 nt, Artificial Sequence
  derived and/or modified CDS sequence (wt) from RVFV(2250/74)__DQ380209.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaaaguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagca

SEQ ID NO: 4567 - RNA, 1680 nt, Artificial Sequence
  derived and/or modified CDS sequence (wt) from RVFV(T1)__DQ380201.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4568 - RNA, 1680 nt, Artificial Sequence
  derived and/or modified CDS sequence (wt) from RVFV(Ken 199800523)__KU978777.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcacgguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaucagca

SEQ ID NO: 4569 - RNA, 1680 nt, Artificial Sequence
  derived and/or modified CDS sequence (wt) from RVFV(1853/78)__DQ380220.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguagacagaugacaggugcuagccuaaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccucgauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggguugugcagauacaagugucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguguucaguucuauugcaauaauuuguuuagcuauucuuuauagggugcucaaaugcuuaaagauugccccaaggaaaguucugaauccacuaauguggauuacagccuucaucagauggguguauaagaagaugguugccagaguggcagacaauauuaaucaagugaacagggagauaggauggauggaaggaggucaguugguucuaggaaacccugccccuauuccucgucaugccccaauuccacguuauagcacauaccuaaugcuacuacuaauugucucauaugcaucagca

SEQ ID NO: 4570 - RNA, 1680 nt, Artificial Sequence
  derived and/or modified CDS sequence (wt) from RVFV(73HB1449)__DQ380211.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagca

SEQ ID NO: 4571 - RNA, 1680 nt, Artificial Sequence
  derived and/or modified CDS sequence (wt) from RVFV(2007000234)__JF326191.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4572 - RNA, 1680 nt, Artificial Sequence
  derived and/or modified CDS sequence (wt) from RVFV(73HB1230)__DQ380221.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccucccaaguaugagcucacugaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagacuaagaaggagcucaaaagcuuugauaucucucagugccccaagauuggaggacaugguaguaagaagugcacuggggacgcagcauuuugcucugcuuaugagugcacugcucaguacgccaaugccuauuguucgcaugcuaaugguucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagaguccuucuaccgagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcucaagugccuaaagauugcuccaaggaaaguucugaauccacuaauguggauuacagccuucaucagauggguguauaagaagaugguugcuagaguggcagacaauauuaaucaagugaacagggaaauaggauggauggaaggaggucaguugguccuagggaacccugccccuauuccucgucaugccccaaucccacguuauagcacauaccuaaugcuacuauugauugucucauaugcaucagca

SEQ ID NO: 4573 - RNA, 1680 nt, Artificial Sequence
  derived and/or modified CDS sequence (wt) from RVFV(ZM-657)__DQ380204.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaagccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4574 - RNA, 1680 nt, Artificial Sequence
  derived and/or modified CDS sequence (wt) from RVFV(Kenya 83 (21445))__DQ380198.1__Gn
auggcagggauugcaaugacaguccuuccagccuuagcaguuuuugcuuuggcaccuguuguuuuugcugaagacccccaccucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacucgugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaaaaaggggucuuacccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucuguuucgagcauaagggacaguauaaaggaacaauggacucuggucagaccaagagggagcucaaaagcuuugauaucucucagugccccaagauuggagggcaugguaguaagaagugcacuggggacgcagcauucugcucugcuuaugagugcacugcucaguacgccaaugccuauuguucacaugcuaaugggucagggauugugcagauucaaguaucaggggucuggaagaagccuuuauguguaggguaugagagagugguugugaagagagaacucucugccaagcccauccagagaguugagccuugcacaacuugcauaaccaaaugugagccucauggauugguuguccgaucaacaggguucaagauaucaucugcaguugcuugugcuagcgggguuugcgucacaggaucgcagaguccuucuacugagauuacacucaaguauccagggauaucucaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagcuuucaucagauggguguauaagaagaugguugcuagaguggcagacaacauuaaucaagugaacagggaaauaggauggauggaaggaggucaguuggcucuagggaacccugccccuauuccucgucaugccccaaucccacguuauagcacauaccuaaugcuacuauugauugucucauaugcaucagca

SEQ ID NO: 4575 - RNA, 1680 nt, Artificial Sequence
  derived and/or modified CDS sequence (wt) from RVFV(SAUDI 200010901)__KU978778.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaagugggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcugcuauugauuaucucauaugcaucagca

SEQ ID NO: 4576 - RNA, 1680 nt, Artificial Sequence
  derived and/or modified CDS sequence (wt) from RVFV(2007004194)__EU574031.1__Gn
auggcagggauugcgaugacaguccuuccagccuuagcaguuuuugcuuuggcaccuguugucuuugcugaagacccccaucucagaaacagaccagggaaaggacacaacuacauugacgggaugacucaggaggaugccacaugcaaaccugugacauaugcuggggcauguagcaguuuugaugucuugcuugaaaaggggaaauuuccccuuuuccagucauaugcucaucauagaacucugcuagaggcaguucaugacaccaucauugcaaaggcugauccaccuagcugugaccuccagagugcucaugggaaucccuguaugaaagagaaacuugugaugaagacacauuguccuaacgacuaccagucagcucauuaccucagcaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggaugcagcauuuugcucugcuuaugaauguacugcucaguaugccaaugccuauuguucacaugcuaaugggucagggauugugcagauucaaguaucaggggucuggaagaaaccuuuaugugugggguaugagagagugguugugaagagagaacucucagccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaaccccgccccuauuccucgucaugccccaaucccacguuauagcacauaccuaaugcuacuacugauugucucauaugcaucagca

SEQ ID NO: 4577 - RNA, 1680 nt, Artificial Sequence
  derived and/or modified CDS sequence (wt) from RVFV(ZH-501-777)__DQ380202.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacccuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4578 - RNA, 1680 nt, Artificial Sequence
  derived and/or modified CDS sequence (wt) from RVFV(ZC-3349)__DQ380207.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuacuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucaggcaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuuuaucagauggauauauaagaagaugguugccagaguggcagacaacauuaaucacgugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4579 - RNA, 1680 nt, Artificial Sequence
  derived and/or modified CDS sequence (wt) from RVFV(200803166)__JF311381.1__Gn
auggcagggauugcgaugacaguccuuccagcccuagcgguuuuugcuuuagcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuuaaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggauccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaaggaggucaguugguucuagggaacccugccccuauuccucgucaugccccaaucccacguuauagcacauaccuaaugcuacuauugauugucucauaugcaacagca

SEQ ID NO: 4580 - RNA, 1680 nt, Artificial Sequence
  derived and/or modified CDS sequence (wt) from RVFV(1260/78)__DQ380214.1__Gn
auggcagggauugcaaugacaguccuuccagccuuagcaguuuuugcucuagcaccuguuguuuuugcugaagacccccaucucagaaacagaccggggaaggggcacaacuacauugacgggaugacucaggaggaugccacaugcaaaccugugacauaugcuggggcauguagcaguuuugaugucuugcuugaaaaagggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacagaggacugcaacuuuuguaggcagaugacaggugcuagccugaagaaggggucuuauccucuccaagacuuauuuugucagucaagugaggacgauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugcuuauuguucacaugcuaaugggucagggauugugcaaauacaaguaucaggggucuggaagaagccuuuauguguaggguaugagagagugguuguaaagagagaacucucugccaagcccauccagagaguugagccuugcacaacuuguauaaccaaaugugagccucauggauugguuguccgaucaacaggguucaaaauaucaucugcaguugcuugugcuagcggaguuugcgucacaggaucgcagaguccuuccaccgagauuacacucaaguauccagggauaucccaguccucugggggggacauagggguucacauggcacaugaugaccagucaguuagcuccaaaauaguagcucacugcccuccccaggacccgugcuuagugcauggcugcauagugugugcucauggccugauaaauuaccagugucacacugcucucagugccuuuguuguuguguuuguguucaguucuauugcaauaauuuguuuagcuauucuucauagggugcucaagugcuuaaagauugccccaaggaagguucugaauccacuaauguggauuacagccuucaucagauggguguauaagaagaugguugccagaguggcagacaauauuaaucaagugaacagggaaauaggauggauggaaggaggucaguugguucuagggaacccugccccuauuccucgccaugccccaauuccacguuauagcacauaccuaaugcuacuauugauugucucauaugcaucagca

SEQ ID NO: 4581 - RNA, 1680 nt, Artificial Sequence
  derived and/or modified CDS sequence (wt) from RVFV(T-46 (228113))__DQ380199.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaaaggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4582 - RNA, 1680 nt, Artificial Sequence
  derived and/or modified CDS sequence (wt) from RVFV(ZINGA J83 R1)__KU978776.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcugaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagca

SEQ ID NO: 4583 - RNA, 1680 nt, Artificial Sequence
  derived and/or modified CDS sequence (wt) from RVFV(clone 13)__DQ380213.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccucuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagcaugagcucacagaggacugcaacuuuuguaggcagaugacaggugcuagccugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcacaagggacaguauaagggaacaauggacucuggucagacuaagagggagcucaaaagcuuugauauuucucagugccccaagauuggaggacaugguaguaagaagugcacuggggacgcagcauuuugcucugcuuaugagugcacugcucaguaugccaaugcuuauuguucacaugcuaaugggucagggauugugcagauacaaguaucaggggucuggaagaagccuuuauguguaggguaugagagagugguugugaagagagaacucucugccaagcccauccagaggguugagccuugcacaacuuguauaaccaaaugugagccucauggauugguuguccgaucaacaggguucaagauaucaucugcaguugcuugugcuagcggaguuugcgucacaggaucgcagaauccuuccaccgagaucacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguucguguucaguucuauugcaauaauuuguuuagcuauucuuuauagggugcucaagugccuaaagauugccccaaggaaaguucugaauccacuaauguggauuacagccuucaucagauggguguauaagaagaugguugccagaguggcagacaauauuaaucaagugaauagggaaauaggauggauggaaggaggucaguugguccuagggaacccugccccuauuccucgccaugccccaauuccacguuauagcacauaccuaaugcuacuauugauugucucauaugcaucagca

SEQ ID NO: 4584 - RNA, 1680 nt, Artificial Sequence
  derived and/or modified CDS sequence (wt) from RVFV(SA01-1322)__KX096942.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccucuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguaggaguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggccagaccaagagggagcucaaaagcuuugauaucucucagugccccaagauuggagggcaugguaguaagaagugcacuggggacgcagcauuuugcucugcuuaugaaugcacugcucaguaugccaaugccuuuuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugaaccucauggauugguuguccgaucaacaggguucaagauaucaucugcaguugcuugugcuagcggaguuugcgucacagggucgcagaguccuucuacugagauuacacucaaguauccagggauaucccaguccucugggggggacauagggguucacauggcacaugaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccauuaauguggauuacagccuucaucagauggguguauaagaagaugguugcuagaguggcggacaauauuaaucaagugaacagggaaauaggauggauggaaggaggucaguugguucuaggggacccugccccuauuccucgucaugccccaaucccacguuauagcacauaccuaaugcugcuauugauuaucucauaugcaucagca

SEQ ID NO: 4585 - RNA, 1680 nt, Artificial Sequence
  derived and/or modified CDS sequence (wt) from RVFV(25010-24)__KM210509.1__Gn
auggcagggauugcaaugacaguccuuccagccuuagcaguuuuugcuuuggcaccuguugucuuugccgaagacccucaucuuagaaacaggccaggaaagggacacaacuacauugacgggaugacucaggaggaugccacauguaaaccugugacauaugcuggggcauguagcaguuuugaugucuugcucgaaaagggaaaauuuccccucuuccagucauacgcucaucauagaacucuacuagaggccguccacgacaccauuauugcaaaggcugauccaccuagcugugaccuucagagugcucaugggaaucccugcaugaaggagaaacucgugaugaagacacacuguccaaaugacuaccagucagcucauuaccuuaacaaugacgggaaaauggccucagucaagugcccuccuaaguaugagcucacugaggacugcaacuuuuguaggcagaugacaggugcuagccugaagaaagggucuuauccucuccaggacuuauuuugucagucaagugaggaugaugggucaaaauuaaaaacaaaaaugaaaggggucugcgaagugggaguucaagcacucaaaaagugugauggccaacucagcacugcacaugagguugugcccuuugcaguauuuaagaacucaaagaagguuuaucuugacaagcuugaccucaagacugaggaaaaucugcuaccagacucauuugucugcuucgagcauaaggggcaguauaaaggaacaauggacucuggucagacaaagagggagcucaaaagcuuugauaucucucagugucccaagauuggagggcaugguagcaagaaauguacuggggacgcagcauucugcucugcuuaugagugcacugcucaauacgccaaugccuauuguucacaugcuaaugggucaggaauuguacagauacaaguauccggggucuggaagaagccuuuguguguaggguaugagagagugguugugaagagagagcucucugccaagcccauccagagaguugagccuugcacaacuuguauaaccaaaugugagccucauggauuaauuguccgaucaacaggguucaagauaucaucugcaguugcuugugcuagcggaguuugcgucacaggaucgcagagcccgucuacugagaucacacucaaguacccagggauaucccaguccucugggggggacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuugucguuguguucguguucagcucuguugcaauaauuuguuuggcuauucuuuauaaggugcucaagugccuaaaaauugccccaaagaaaguucuaaauccacugauguggauuacugcuuucaucagauggguguauaagaagaugguugccagaguggcagacaauaucaaucaagugaacagggaaauaggauggauggaaggaggccaguuagcucuagggaauccugcuccuaucccucgucaugcuccaauuccacguuauagcacauaccuaaugcuacuauugauugucucauaugcaucagca

SEQ ID NO: 4586 - RNA, 1680 nt, Artificial Sequence
  derived and/or modified CDS sequence (wt) from RVFV(200803162)__JF311377.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaauaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauagccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuaaggaacccugccccuauuccucgucaugccccaaucccacguuauagcacauaccuaaugcuacuauugauugucucauaugcaucagca

SEQ ID NO: 4587 - RNA, 1680 nt, Artificial Sequence
  derived and/or modified CDS sequence (wt) from RVFV(2007002476)__EU574036.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucaaauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4588 - RNA, 1680 nt, Artificial Sequence
  derived and/or modified CDS sequence (wt) from RVFV(Hv-B375)__DQ380218.1__Gn
auggcagggauugcaaugacaguccuuccagccuuggcaguuuuugcuuuggcaccuguuguuuuugcugaggacccccaucucagaaacagaccagggaaggggcacaacuacauugacgggaugacccaggaggaugccacaugcaaaccugugacauaugcuggggcauguagcaguuuugaugucuugcuugagaaggggaaauuuccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaagaaugagcucacugaggacugcaacuuuuguaggcagaugacaggugcuagccuaaagaaggggucuuauccucuccaagacuuauuuugccagucaagugaggaugauggaucaaaauuaaaaacaaaaaugaaaggggucugcgaaguggggguccaagcacucaaaaagugugauggccaacucagcaccgcacaugagguugugcccuuugcaguguucaagaacucaaagaagguuuaccucgauaagcuugaccucaagacugaggagaaucugcugccagacucauuugucugcuucgagcauaagggacaguauaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaagugucaggggucuggaagaagccuuuauguguaggguaugagagagugguugugaagagagaacucucugccaagcccauccagagaguugagccuugcacaacuuguauaaccaaaugugagccucaugguuugguuguccgaucaacaggguucaagauaucaucugcaguugcuugugcuagcggaguuugcgucacaggaucacagagcccuucuaccgagauuacacucaaguauccagggauaucccaguccucugggggggacauagggguucacauggcacacgaugaucagucaguuagcuccaaaauaguagcucacugcccuccccaggacccaugcuuagugcacggcugcauagugugugcucauggccugauaaauuaccagugucacacugcccucagugccuuuguuguuguguuuguauucaguucuauugcaauaauuuguuuagccauucuuuauagggugcucaagugcuuaaagauugccccaaggaaaguucugaauccacuaauguggaucacagccuucaucagauggguguauaagaagaugguugccagaguggcagacaauauuaaucaagugaacagggagauaggauggauggaaggaggucaguugguucuagggaacccugcuccuauuccucgucaugccccaauuccacguuauagcacauaccuaaugcuacugcuaauugucucauaugcaucagca

SEQ ID NO: 4589 - RNA, 1680 nt, Artificial Sequence
  derived and/or modified CDS sequence (wt) from RVFV(OS-1)__DQ380186.1__Gn
auggcagggauugcaaugacaguccuuccagccuuagcaguuuuugcuuuggcaccuguuguauuugcugaagacccccaucucagaaauagaccagggaaggggcacaacuacauugacgggaugacucaggaggaugccacuuguaaaccugugacauaugcuggggcauguagcaguuuugaugucuugcucgaaaagggaaaauucccccucuuccagucguaugcucaucauagaacucuacuagaggcaguucaugacaccaucauugcaaaggcugauccaccuaguugugaucuucagagugcucaugggaauccuugcaugaaagagaaacucgugaugaagacacacuguccaaaugacuaccagucagcccacuaccucaacaaugaugggaaaauggccucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaggcacucaagaagugugauggccagcucagcacugcacaugagguugugcccuuugcaguguuuaagaacucaaagaagguuuaucuugacaagcuugaccucaaaacugaagaaaaucugcuaccagacucauuugucugcuucgagcauaagggacaguauaaaggaacaauggacucuggucaaacuaagagggagcucaaaagcuuugauaucucucagugccccaagauuggaggacaugguagcaagaagugcacuggggacgcagcauuuugcucugcuuaugagugcacugcucaauacgccaaugccuauuguucacaugcuaaugggucaggaguugugcagauacaaguauccggggucuggaagaaaccuuuauguguaggguaugagagagugguugugaagagagaacucucugccaaacccauccagagaguugagccuugcacaaccuguauaaccaaaugugagccucauggauugguuguccgaucaacaggguucaagauaucaucugcaguugcaugugcuagcggaguuugugucacaggaucgcagaguccuucuaccgagaucacacucaaguauccagggauaucccaguccucugggggggacauagggguucacauggcacacgaugaucagucaguuagcuccaaaauaguagcucacugcccuccccaggacccgugccuagugcauggcugcauagugugugcucauggccuaauaaauuaccagugucacacugcucucagugccuuuguuguuguguucguauucagcucuguugcaauaauuuguuuggccauucuuuauaaggugcucaagugccuaaagauugccccaaggaaaguucuaaauccacuaauguggauuacugccuucaucagauggguguauaagaagaugguugccaggguggcagacaauauuaaucaagugaacagagaaauaggauggauggagggaggucaguuggcucuagggaacccugccccuauuccucgucaugccccaauuccacguuauagcacauaccugaugcuacuauugauugucucauaugcaucagca

SEQ ID NO: 4590 - RNA, 1680 nt, Artificial Sequence
  derived and/or modified CDS sequence (wt) from RVFV(2373/74)__DQ380194.1__Gn
auggcagggauugcaaugacaguccuuccagccuuagcaguuuuugcuuuggcaccuguuguuuuugcugaagacccucaucucagaaacagaccagggaaggggcacaacuacauugacgggaugacucaggaggaugccacauguaaaccugugacauaugcuggggcauguagcaguuuugaugucuugcucgaaaagggaaaauucccccucuuccagucauaugcucaucauagaacucuacuagaggcaguucacgacaccaucauugcaaaggcugacccaccuagcugugaccuccagagugcucaugggaaucccugcaugaaagagaaacucgugaugaagacacacugcccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaggacuuguucugucaaucaagugaggaugauggaucaaaauuaaaaacaaaaaugaaaggggucugcgaaguggggguucaagcacucaaaaagugugauggccaacucagcacugcacaugagguugugccauuugcaguguuuaaaaacucaaagaagguuuaucuugacaagcuugaccucaagacugaggaaaaucugcuaccagacucauuugucugcuucgagcauaagggacaguauaaagggacaauggacucuggucagacuaagagggagcucaaaaguuuugauaucucucagugccccaagauuggaggacaugguagcaagaagugcacuggggacgcagcauuuugcucugcuuaugagugcacugcucaauacgccaaugccuauuguucacaugcuaaugggucaggaauuguacagauacaaguauccggggucuggaagaagccuuuauguguaggauaugagagagugguugugaagagagaacucucugcuaagcccauccagagaguugagccuugcacaacuuguauaaccaaaugcgagccucauggguugguuguccgaucaacaggguucaagauaucuucugcaguugcuugugcuagcggaguuugcgucacaggaucacagagcccuucuaccgagauuacacucaaguauccaggaauaucccaguccucugggggggacauagggguucacauggcacaugaugaucagucaguuagcuccaaaaugguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagguggguguauaagaagaugguugccagaguggcagacaauaucaaucaagugaacagggaaauaggauggauggaaggaggccaguuggcucuagggaacccugccccuauuccucgucaugccccaauuccacguuauagcacauaccuaaugcuacuauugauugucucauaugcaucagca

SEQ ID NO: 4591 - RNA, 1680 nt, Artificial Sequence
  derived and/or modified CDS sequence (wt) from RVFV(Kenya 57 (Rintoul))__DQ380192.1__Gn
auggcagggauugcaaugacaguccuuccagccuuagcaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaccaucauugcaaaggcugauccaccuagcugugaccuucagagugcucaugggaaucccugcaugaaagagaaacucguaaugaagacacacuguccaaaugacuaccagucagcucauuaccucaacaaugacgggaaaauggcuucagucaagugcccuccuaaguaugagcucacugaggacugcaacuuuuguaggcagaugacaggugcuagcuugaagaaggggucuuauccucuccaagacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguagcucacugccccccccaggacccgugccuagugcauggcugcauagugugugcucauggcuugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggccaguugguucuagggaacccugccccuauuccucgucaugcuccaauuccacguuauagcacauaccuaaugcugcuauugauugucucauaugcaucagca

SEQ ID NO: 4592 - RNA, 1680 nt, Artificial Sequence
  derived and/or modified CDS sequence (wt) from RVFV(Sudan 2V-2007)__JQ820490.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuccagagugcucaugggaaucccuguaugaaagagaaacuugugaugaagacacauuguccaaaugacuaccagucagcucauuaccucaacaaugacgggaaaauggccucagucaagugcccaccuaaguaugagcucacugaggacugcaacuuuuguagacagaugacaggugcuagccugaagaaggggucuuauccucuccaagacuuauuuugucagucgagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaaggucuaucuugauaagcuugaccucaagacugaggagaaucugcuaccagacucauuugucugcuucgagcauaagggacaguauaaaggaacaauggacucuggucagaccaagagggagcucaagagcuuugauaucucucagugccccaagauuggagggcaugguaguaagaagugcacuggggaugcagcauuuugcucugcuuaugaaugcacugcucaguaugccaaugccuauuguucacaugcuaaugggucagggauugugcagauucaaguaucaggggucuggaagaaaccuuuguguguaggguaugagagagugguugugaagagagaacucucugccaaacccauccagagaguugagccuugcacaacuugcauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggauauagggguucacauggcacacgaugaucagucaguuagcuccaaaauaguagcucacugccccccccaggacccgugcucagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagagaaauaggauggauggaaggaggucaguugguucuagggaacccugccccuauuccucgucaugccccaaucccacguuauagcacauaccuaaugcuacuauugauugucucacaugcaucagca

SEQ ID NO: 4593 - RNA, 1680 nt, Artificial Sequence
  derived and/or modified CDS sequence (wt) from RVFV(200803167)__JF311382.1__Gn
auggcagggauugcgaugacaguccuuccagccuuagcaguuuuugcuuuggcaccuguuguuuuugcugaagaccuccaucucagaaacagaccagggaaggggcacaacuacauugacgggaugacucaggaggaugccacaugcaaaccugugacauaugcuggggcauguagcaguuuugaugucuugcuugaaaaggggaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguaggcagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaaugggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauugcacucaaguauccagggauaucccaguccucugggggggauauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguuguuguauuuguauucaguucuauugcaauaauuugcuuagcuauucuuuauagggugcucaagugccuaaagauugccccaaggaaaguucugaauccacuaauguggauuacagccuucaucagauggguguauaagaagaugguugcuagaguggcggacaauauuaaucaagugaacagggaaauaggauggauggaagggggucaguugguucuagggaacccugccccuauuccucgucaugccccaaucccacguuauagcacauaccuaaugcuacuauugauugucucauaugcaucagca

SEQ ID NO: 4594 - RNA, 1680 nt, Artificial Sequence
  derived and/or modified CDS sequence (wt) from RVFV(KEN/Gar-008/06)__HM586965.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4595 - RNA, 1680 nt, Artificial Sequence
  derived and/or modified CDS sequence (wt) from RVFV(ANK-6087)__DQ380216.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugagaaggggaaauucccccuuuuccagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaccuugauaagcuugaccucaagacugaggagaaucugcuaccagacucauuugucugcuucgagcauaagggacaguauaaaggaaaauuggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagaguaguugugaagagagaacucucugccaagcccauccagagaguugagccuugcacaacuuguauaaccaaaugugagccucauggguugguuguccgaucaacaggguucaagauaucaucugcaguugcuugugcuagcggaguuugcgucacaggaucgcagaguccuuccaccgagauuacacucaaguauccagggauaucccaguccucuggaggggacauagggguucacauggcacacgaugaucagucaguuagcuccaaaauaguagcucacugcccuccccaggacccgugcuuagugcacggcugcauagugugugcucauggccugauaaauuaccagugucacacugcucucagugccuuuguuguuguguuuguauucaguucuauugcaauaauuuguuuagcuauucuuuauagggugcucaagugccuaaagauugccccaaggaaaguucugaauccacuaauguggauuacagccuucaucagauggguguauaggaagaugguugccagaguggcagacaauauuaaucaagugaacagggagauaggauggauggaaggaggucaguugguucuagggaacccugccccuauuccucgucauguuccaauuccacguuauagcacauaccuaaugcuacuacugauugucucauaugcaucagca

SEQ ID NO: 4596 - RNA, 1680 nt, Artificial Sequence
  derived and/or modified CDS sequence (wt) from RVFV(763/70)__DQ380188.1__Gn
auggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugggcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagaucacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagcuggcucuagggaacccugccccuauuccucgucaugcuccaauuccacguuauagcacauacuuaaugcuacuauugauugucucauaugcaucagca

SEQ ID NO: 4597 - RNA, 1680 nt, Artificial Sequence
  derived and/or modified CDS sequence (wt) from RVFV(BIME-01)__KX609032.1__Gn
auggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagca

SEQ ID NO: 4598 - RNA, 1680 nt, Artificial Sequence
  derived and/or modified CDS sequence (wt) from RVFV(KEN07-KUR340)__EF460404.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugacaucucucagugccccaagauuggagggcaugguaguaagaagugcacuggggacgcagcauucugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauaggaugcucaagugcuuaaagauugccccaaggauaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4599 - RNA, 1680 nt, Artificial Sequence
  derived and/or modified CDS sequence (wt) from RVFV(SA-51 (Van Wyck))__DQ380195.1__Gn
auggcagggauugcaaugacaguccuuccagccuuagcaguuuuugcuuuggcaccuguuguuuuugcugaagacccccaucucagaaacagaccagggaagggacacaacuacauugacgggaugacucaggaggaugccacauguaaaccugugacauaugcuggggcauguagcaguuuugaugucuugcucgaaaagggaaaauuuccccuuuuucagucguaugcucaucauagaacucuacuagaggcaguucacgacaccaucauugcaaaggcugauccaccuagcugugaccuucagagugcucaugggaaucccugcaugaaagagaaacucgugaugaagacacacuguccaaaugacuaccagucagcucauuaccucaacaacgacgggaaaauggcuucagucaagugcccuccuaaguaugagcucacugaggacugcaacuuuuguaggcagaugacaggugcuagccugaagaaggggucuuauccucuccaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccucaaaacugaggaaaaucugcuaccagacucauuugucugcuucgagcauaagggacaguauaaaggaacaauggacucuggucagacuaagagggagcucaagagcuuugauaucucucagugccccaagauuggaggacgugguagcaagaagugcacuggggacgcagcauuuugcucugcuuaugagugcacugcucaauacgccaaugccuauuguucacaugcuaaugggucaggaauugugcagauacaaguaucaggggucuggaagaagccuuuauguguaggauaugagagagugguugugaaaagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacagagauuacacucaaguacccagggauaucccaguccucuggaggggacauagggguucacauggcacacgaugaucagucaguuagcuccaaaauaguagcucacugccccccccaagacccgugcuuagugcauggcugcauagugugugcucauggccugauaaauuaccagugucacacugcucucagugccuuuguuguuguguucguauucagcucuguugcaauaaucuguuuagccauucuuuauaaggugcucaagugccuaaagauugccccaaggaaaguucugaauccacuaauguggauuacugccuucaucagauggguguauaagaagaugguugccagaguggcagacaauauuaaucaagugaacagggagauaggauggauggaaggaggucaguuggcucuagggaauccugccccuauuccucgucaugcuccaauuccacguuauagcacauaccuaaugcuacuauugauugucucauaugcaucagca

SEQ ID NO: 4600 - RNA, 1680 nt, Artificial Sequence
  derived and/or modified CDS sequence (wt) from RVFV(Lunyo)__KU167026.1__Gn
auggcagggauugcaaugacaguccuuccagccuuagcaguuuuugcuuuggcaccuguuguuuuugcugaagacccucaucucagaaauagaccagggaaggggcacaacuacauugacgggaugacucaggaggaugccacauguaaaccugugacauaugcuggggcauguagcaguuuugaugucuugcuugaaaagggaaaauuuccccucuuccagucguaugcucaucauagaacucuacuggaggcaguucaugacaccaucauugcaaaggcugauccaccuagcugugaccuucagagugcucaugggaaucccugcaugaaagagaaacucgugaugaagacacacuguccaaaugacuaccagucagcucauuaccucaacaaugacgggaaaauggcuucagucaagugcccuccuaaguaugagcucacugaagacugcaacuuuuguaggcagaugacaggugcuagcuugaagaaggggucuuauccccuccaggaccuauuuugucagucaagugaggaugauggaucaaaauuaaaaacaaaaaugaaaggggucugcgaaguugggguucaagcacucaaaaagugugauggccaacucagcacugcacaugagguugugcccuuugcaguguuuaagaacucaaagaagguuuaucuugauaagcuugaccucaagacugaggaaaaucugcuaccagacucauuugucugcuucgagcacaagggacaguauaaaggaacaauggucucuggucagacuaagagggagcucaaaagcuuugauaucucucagugucccaagauuggaggacaugguagcaagaagugcacuggggacgcagcauuuugcucugcuuaugagugcacugcucaauaugccaaugccuauugcucacaugcuaauggaucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccggucaacaggguucaagauaucaucugcaguugcuugugcuagcggaguuugcgucacaggaucgcagaguccuucuaccgagauuacacucaaguauccagggauaucccaguccucugggggggacauagggguucacauggcacaugaugaucagucaguuaguuccaaaauaguagcucacugcccuccccaggacccgugccuagugcauggcugcauagugugugcucauggccugauaaauuaccagugucacacugcucucagugccuuuguuguuguguucguauucagcucuguugcaauaauuuguuuggccauucuuuauaaggugcucaagugccuaaagauugccccaaggaaaguucugaauccacuaauguggauuacugccuucaucagauggguguauaagaagaugguugccagaguggcagacaauaucaaucaagugaacagggaaauaggauggauggaaggaggucaguuggcucuagggaacccugccccuauuccucgucaugcuccaauuccacguuauagcacauaccuaaugcuacuauugauugucucauaugcaucagca

SEQ ID NO: 4601 - RNA, 1680 nt, Artificial Sequence
  derived and/or modified CDS sequence (wt) from RVFV(2269/74)__DQ380222.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacauguaaaccugugacauaugcuggggcauguagcaguuuugaugucuugcucgaaaaggggaaauucccccucuuccagucguaugcucaucauagaacucuacuagaggcaguucacgacacuaucauugcaaaggcugacccaccuagcugugaccuucagagugcucaugggaaucccugcaugaaagagaagcucgugaugaagacacacuguccaaaugacuaccaaucagcucauuaccuuaacaaugacgggaaaauggcuucagucaagugccccccuaaguaugagcucacugaggauugcaacuuuuguaggcagaugacaggugcuagccugaagaaggggucuuauccucuccaggacuuauuuugucagucaagugaggaugaugggucaaaauuaaaaacaaaaaugaaaggggucugcgaagugggaguucaagcacuaaaaaagugugauggccaacucagcacugcacaugagguugugcccuucgcaguguuuaagaacucaaagaagguuuaucuugauaagcuugaccuuaagacugaggaaaaucugcuaccagacucauuugucugcuucgagcauaaaggacaacauaaaggaacaauggacucuggucagaccaagagggagcucaaaagcuuugauaucucucagugccccaagauuggaggacaugguagcaagaagugcacuggggacgcagcauuuugcucugcuuaugagugcacugcucaguacgccaaugccuauuguucacaugcuaaugggucaggaauugugcagauacaagugucaggggucuggaagaagccuuuauguguaggguaugagagagugguuguaaagagagaacucucugccaagcccauccagagaguugagccuugcacaacuuguauaaccaaaugcgagccucauggacugguuguccgaucaacaggguucaagauaucaucugcaguugcuugugcuagcggaguuugcgucacaggaucgcagaguccuucuaccgagauuacacucaaguauccaggaauaucucaguccucugggggggacauagggguucacauggcacacgacgaucagucaguuagcuccaaaauaguagcucacugccccccccaggacccgugcuuagugcauggcugcauagugugugcucauggccugauaaauuaccagugucacacugcucucagugccuuuguuguuguguucguguucagcucuguugcaauaauuuguuuggccauucuuuauaaggugcucaagugccuaaagauugccccaaagaaaguucugaauccgcuaauguggauuacugccuucaucagauggguauauaagaagaugguugccagaguggcagauaauauaaaucaagugaacagggaaauaggauggauggaaggaggucaguuggcucuagggaacccugccccuauuccucgucacgcuccaaucccacgcuauagcacauaccuaaugcuacuacugauugucucauaugcgucagca

SEQ ID NO: 4602 - RNA, 1680 nt, Artificial Sequence
  derived and/or modified CDS sequence (wt) from RVFV(MgH824)__DQ380210.1__Gn
auggcagggauugcaaugacaguccuuccagccuuagcaguuuuugcuuuggcaccuguuguuuuugcugaagacccccaucucagaaacagaccagggaagggguacaacuacauugacgggaugacucaggaggaugccacaugcaaaccugugacauaugcuggggcauguagcaguuuugaugucuugcuugaaaaggggaaauuuccccuuuuccagucguaugcucaucauagaacucuacuagaggcaguucacgacaccaucauugcaaaggcugacccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcguaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacuacucaguacgccaaugccuauuguucacaugcuaaugggucagggguugugcagauacaagugucaggggucuggaagaagccuuuauguguaggauaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcauggcugcauagugugugcucauggccugauaaauuaccagugccacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaauauuaaucaagugaacagggaaauaggauggauggaaggaggucaguugguucuagggaacccugccccuauuccucgucaugccccaaucccacguuauagcacauaccugauguuacuauugauugucucauaugcaucagca

SEQ ID NO: 4603 - RNA, 1680 nt, Artificial Sequence
  derived and/or modified CDS sequence (wt) from RVFV__JQ068143.1__Gn
auggcagggauugcaaugacaguccuucccgccuuagcaguuuuugcuuuggcaccuguuguuuuugcugaggacccucaucucagaaacagaccagggaagggacacaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugacccaccuagcugugaucuucagagugcucaugggaaccccugcaugaaagagaaacucgugaugaagacacacuguccaaaugacuaccagucagcucauuaucucaacaaugacgggaaaauggcuucagucaagugcccuccuaaguaugagcucacugaggacugcaacuuuuguaggcagaugacaggugcuagcuugaagaaggggucuuauccucuccaggacuuauuuugucagucaagugaggaugaugggucaaaauuaaagacaaaaaugaaaggggucugcgaaguggggguucaagcacucaaaaagugugauggccaacucagcacugcacaugagguugugcccuuugcaguguuuaagaacucaaagaagguuuaucuugacaagcuugaccucaagacugaagaaaaucugcuaccagacucauuugucugcuuugagcauaaaggacaguauaaaggaacaauagacucuggucagacuaagagagagcucaaaagcuuugauaucucucagugccccaagauuggaggacaugguagcaagaagugcacuggggacgcagcauuuugcucugcuuaugaguguacugcucaguaugccaaugccuauuguucacaugcuaaugggucugggauuguacagauacaaguguccggggucuggaagaagccucuguguguaggauaugagagagugguugugaagagagaacucucugccaagcccauccagagaguugagccuugcacaacuugcauaaccaaaugugagccucauggauugguuguccgaucaacaggguuuaagauaucaucugcaguugcuugugcuagcgggguuugcgucacaggaucgcagagcccuucuacugagaucacucuuaaguauccagggauaucccaauccucugggggggacauaggaguucacauggcacaugaugaucagucaguuagcuccaaaauaguggcucacugccccccccaggacccgugccuagugcauggcugcauagugugugcucauggcuugauaaauuaccagugucacacugcucucagugcuuuuguuguuguauucguauucagcucuguugcaauaauuugucuggccauccuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcuccuauuccucgucaugcuccaauuccacguuauagcacguaucuaaugcuacuauugauuaucucauaugcaucagca

SEQ ID NO: 4604 - RNA, 1680 nt, Artificial Sequence
  derived and/or modified CDS sequence (wt) from RVFV(RVFBJ01/2016)__KX785331.1__Gn
auggcagggauugcaaugacaguucuucccgccuuagcaguuuuugcuuuggcaccuguuguuuuugcugaggacccucaucucagaaacagaccagggaagggacauaacuacauugacgggaugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaagcaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaggcacucaaaaagugugauggccaacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauaguggcucacugccccccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcacccauuccucgucaugcuccgauuccacguuauagcacauaccuaaugcuacuauugauuaucucauaugcaucagca

SEQ ID NO: 4605 - RNA, 1680 nt, Artificial Sequence
  derived and/or modified CDS sequence (wt) from RVFV(KEN/Kil-006/07)__HM586966.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4606 - RNA, 1680 nt, Artificial Sequence
  derived and/or modified CDS sequence (wt) from RVFV(SA-75)__DQ380189.1__Gn
auggcaaggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagca

SEQ ID NO: 4607 - RNA, 1680 nt, Artificial Sequence
  derived and/or modified CDS sequence (wt) from RVFV(35/74)__JF784387.1__Gn
auggcagggauugcaaugacaguccuuccagccuuagcaguuuuugcuuuggcaccuguuguuuuugcugaagacccucaucucagaaacagaccagggaaggggcacaacuacauugacgggaugacucaggaggacgccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaaucccugcaugaaggagaaacucgugaugaagacacacuguccaaaugacuaccagucagcucauuaccucaacaaugacgggaaaauggcuucagucaagugcccuccuaaauaugagcucacugaggacugcaauuuuugcaggcagaugacaggugcuagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcucaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaguuguacagauacaaguauccggggucuggaagaagccuuugugugucggguaugagagggugguugugaagagagaacucucugcuaagcccauccagagaguugagccuugcacaacuuguauaaccaaaugugagccucacggauugguuguccgaucaacagguuucaagauaucaucugcaguugcuugugcuagcggaguuugcguuacaggaucgcagagcccuucuaccgagauuacacucaaguauccagggauaucccaguccucugggggggacauagggguucacauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucuggauccacuaauguggauuacuguuuucaucagauggguguauaagaagaugguugccagaguagcagacaauaucaaucaggugaacagggaaauaggauggauggaaggaggccagcuggcucuagggaacccugccccuauuccucgucaugcuccaauuccacguuauagcacauaccuaaugcuacuauugauugucucauaugcaucagca

SEQ ID NO: 4608 - RNA, 1680 nt, Artificial Sequence
  derived and/or modified CDS sequence (wt) from RVFV__M11157.1__Gn
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucagagugcucaugggaaccccugcaugaaagagaaacucgugaugaagacacacuguccaaaugacuaccagucagcucauuaccucaacaaugacgggaaaauggcuucagucaagugcccuccuaaguaugggcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacacaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccguguuuagugcauggcugcauagugugugcucauggccugauaaauuaccagugucacacugcucucagugccuuuguuguuguguuuguauucaguucuauugcaauaauuuguuuagcuguucuuuauagggugcuuaagugccugaagauugccccaaggaaaguucugaauccacuaauguggaucacagccuucaucagauggauauauaagaagaugguugccagaguggcacacaacauuaaucaagugaacagggaaauaggauggauggaaggaggucaguugguucuagggaacccugccccuauuccucgucaugccccaaucccacguuauagcacauaccugauguuauuauugauugucucauaugcaucagca

SEQ ID NO: 4609 - RNA, 1680 nt, Artificial Sequence
  derived and/or modified CDS sequence (wt) from RVFV(KEN/Bar-035/07)__HM586969.1__Gn
auggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcugacgguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4610 - RNA, 1680 nt, Artificial Sequence
  derived and/or modified CDS sequence (wt) from RVFV(Kenya 56 (IB8))__DQ380190.1__Gn
auggcagggauugcaaugacaguccuuccagccuuagcaguuuuugcuuuggcaccuguuguuuuugcugaagacccucaucucagaaacagaccagggaaggggcacaacuacauugacgggaugacucagggggaugccacaugcaaaccugugacauaugcuggggcuuguagcaguuuugaugucuugcucgaaaagggaaaauucccccucuuccagucguaugcccaucacagaacccuacuagaagcaguucacgacaccaucauugcaaaggcugauccaccuagcugugaccuucagagugcucaugggaauccuugcaugaaggagaaacucgugaugaagacacacuguccaaaagacuaccagucagcucauuaccucaacaaugacgggaaaauggcuucagucaagugcccuccuaaauaugagcucacugaggacugcaauuuuugcaggcagaugacaggugccagcuugaagaaggggucuuauccucuucaggacuuauuuugucagucaagugaggaugauggaucaaaauuaaaaacaaaaaugaaaggggucugcgaaguggggguucaagcacucaaaaagugugauggccaacucagcacugcacaugagguugugcccuuugcaguauuuaagaacucaaagaagguuuaucuugauaagcuugaccucaagacugaggaaaaucuguugccagacucauuugucugcuucgagcauaagggacaguauaaaggaacaauggacucuggucagaccaagagggagcuaaaaagcuuugauaucucucagugccccaagauuggaggacaugguagcaagaagugcacuggggacgcagcuuuuugcucugcuuaugagugcacugcucaauacgccaaugcuuauuguucacaugcuaaugggucaggaauuguacagauacaaguauccggggucuggaagaggccuuuguguguaggguaugagagggugguugugaagagagaacucucugcuaagcccauccagagaguugagccuugcacaacuuguauaaccaaaugugagccucauggauugguuguccgaucaacagguuucaagauaucaucugcaguugcuugugcuagcggaguuugcguuacaggaucgcagagcccuucuaccgagauuacacucaaguauccagggaugucccaguccucugggggggacauagggguucauauggcacaugaugaucagucaguuagcuccaaaauaguagcucacugcccuccccaggauccaugccuagugcauggcugcauagugugugcucauggccugauaaauuaccagugucacacugcucucagugccuuuguuguuguguucguauuuagcucugucgcaauaauuuguuuggccauucuuuauaaaguucucaagugccuaaagauugccccaaggaaaguucugaauccacuaauguggauuacugcuuucaucagauggguguauaagaagaugguugccagaguggcagacaauaucaaucaggugaacagggaaauaggauggauggaaggaggccagccggcucuagggaacccugccccuauuccucgucaugcuccaauuccacguuauagcacauaccuaaugcuacuauugauugucucauaugcaucagca

SEQ ID NO: 4611 - RNA, 1680 nt, Artificial Sequence
  derived and/or modified CDS sequence (wt) from RVFV(KEN/Bar-032/07)__HM586968.1__Gn
auggcagggauugcgaugacaguccuuccagccuuagcaguuuuugcuuuggcaccuguuguuuuugcugaagacccccaucucagaaacagaccagggaaggggcacaacuacauugacgggagacuucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugacccaccuagcugugaccuucagagugcugaugguaauaaauguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaaaugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaguaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugugggggacauagggguucacauggcacacgaugaucagucaguuagcuccaaaauaguagcucacugcccuccccaggacccgugcuuagugcauggcugcauagugugugcucauggccugauaaauuaccagugucacacugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4612 - RNA, 1680 nt, Artificial Sequence
  derived and/or modified CDS sequence (wt) from RVFV(Beijing-01)__KX611606.1__Gn
auggcagggauugcaaugacaguucuucccgccuuagcaguuuuugcuuuggcaccuguuguuuuugcugaggacccucaucucagaaacagaccagggaagggacauaacuacauugacggggugacucaggaggaugccacaugcaaaccugugacauaugcuggggcauguagcaguuuugauguuuugcucgaaaagggaaaauucccccucuuccagucauaugcucaucauagaacucuacuagaggcaguucacgacaccaucauugcaaaggcugauccaccuagcugugaucuccagagugcucaugggaaucccugcaugaaagagaaacucgugaugaagacacacuguccaaaugacuaccagucagcucauuaccucaacaaugacgggaaaauggcuucagucaagugcccuccuaaguaugagcuuacugaggacugcaacuuuuguaggcagaugacaggugcuagcuugaagaaggggucuuauccucuccaggacuuauuuugucagucaagugaggaugauggaucaaaacuaaagacaaaaaugaaaggggucugcgaaguggggguucaagcacucaaaaagugugauggccgacucagcacugcacaugagguugugcccuuugcaguguuuaagaauucaaagaagguuuaucuugacaagcuugaccuuaagacugaagaaaaucugcuaccagacucauuugucugcuuugagcauaagggacaguauaaaggaacaauggacucuggucagacuaagagggagcucaaaagcuuugauaucucucagugccccaagauugggggacaugguagcaagaagugcacuggggacgcagcauuuugcucugcuuaugaguguacugcucaauaugccaaugccuauuguucacaugcuaaugggucugggauuguacagauacaaguauccggggucuggaagaagccuuuaugugugggguaugagagagugguugugaagagagaacucucugccaagcccauccagagaguugagccuugcacaacuugcauaaccaaaugugagccucauggauugguuguccgaucaacaggguucaagauaucaucugcaguugcuugugccagcggaguuugcgucacaggaucgcagagcccuucuacugagaucacucucaaguauccagggauaucccaguccucugggggggauauagggguucacauggcacaugaugaucagucaguuagcuccaaaauagucuuugacugcccuccccaggacccgugccuagugcauggcugcauagugugugcucauggcuugauaaauuaccagugucacacugcucuuagugcuuuuguuguuguguucguauucagcucuguugcaauaauuugucuggccauucuuuauaaggugcucaggugccuaaagauugccccaaagaaaguucugaauccacuaauguggaucacugccuucaucagauggguguauaagaagaugguugccagaguggcagacaauaucaaucaagugaacagagaaauaggauggauggaaggaggccaguuggcucuagggaacccugcucccauuccucgucaugcuccgauuccacguuauagcacauaccuaaugcuacuauugauuaucucauaugcaucagca

SEQ ID NO: 4613 - RNA, 1680 nt, Artificial Sequence
  derived and/or modified CDS sequence (wt) from RVFV(Smithburn)__DQ380193.1__Gn
auggcagggauugcaaugacagucuuuccagccuuaguaguuuuugcuuuggcaccuguuguuuuugcugaagacccucaucucagaaacagaccagggaagggacacaacuacauugacgggaugacucaggaggaugccacauguaaaccugugacauaugcuggggcauguagcaguuuugaugucuugcucgaaaagggaaaauuuccccucuuccagucguaugcucaucauagaacucuauuagaggcaguucacgacaucaucauugcaaaggcugauccaccuagcuguaaccuucagagugcucaugggaaucccugcaugaaagagaaacucguaaugaagacauacuguccaaaugacuaccagucagcucauuaccucaacaaugacgggaaaauggcuucagucaagugcccuccuaagcaugagcucacugaggacugcaacuuuuguaggcagaugacaggugcuagcuugaaggaggggucuuauccucuccaagacuuauuuugucagucaagugaggaugauggaucaaaauuaaaaacaaaaaugaaaggggucugcgaaguggggguucaaguacucaaaaagugugauggccaacucagcacugcacaugaaguugugcccuuugcaguguuuaagaacucaaagaagguuuaucuugacaagcuugaccucaagacugaggaaaaucugcuaccagacucauuugucugcuucgagcauaagggacaguacaaaggaacaauggacucuggucagauuaagagggagcucaaaagcuuugauaucucucagugccccaagauuggaggacaugguagcaagaagugcacuggggacgcagcauuuugcucugcuuaugaguguacugcucaauacgccaaugccuauuguucacaugcuaaugggucaggaauuguacagauacaaguauccggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucugcaguugcuugugcuagcggaguuugcgucacaggaucgcagagcccuucuacugagauuacacucaaguauccagggauaucccaguccucugggggagacauagggguucacauggcacaugaugaucagucaguuagcuccaaaauaguggcccacugccccccccaggacccgugccuagugcauggcugcauagugugugcucauggcuugauaaauuaccagugucacacugcuuucagugccuuuguuguuguguucguauucagcucuguugugauaauuuguuuggccauucuuuauaaggugcucaagugccuaaagauugccccaaggaaaguucugaauccacuaauguggaucacugccuucaucagauggguguauaagaagaugguugccagaguggcagacaauauuaaucaaguaaacagggaaauaggauggauggaaggaggccaguugguucuagggaacccugccccuauuccucgucaugcuccaauuccacguuauagcacauaccuaaugcugcuauugauugucucauaugcaucagca

SEQ ID NO: 4614 - RNA, 1680 nt, Artificial Sequence
  derived and/or modified CDS sequence (wt) from RVFV(TAN/Dod-002/07)__HM586971.1__Gn
auggcagggauugcgaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguccaagcacucaaaaagugugauggccaacucagcacugcacaugagguugugcccuuugcaguguuuaaaaacucaaagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagugcacuggggacgcagcauuuugcucugcuuaugaaugcacugcucaguaugccaaugccuauuguucacaugcuaacgggucagggauugugcagauucaaguaucaggggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucaggccuggauaaucucucaguggcacacggcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4615 - RNA, 1680 nt, Artificial Sequence
  derived and/or modified CDS sequence (wt) from RVFV(KEN/Gar-004/06)__HM586964.1__Gn
auggcagggauugcgaugacaguccuuccagccuuagcaguuuuugcuuuggcaccuguuguuuuugcugaagacccccaucucagaaacagaccagggaaggggcacaacuacauugacggaaugacucaggaggaugccacaugcaaaccugugacauaugcuggggcauguagcaguuuugaugucuugcuugaaaagggaaaauuuccccuuuuccagucauaugcucaucauagaacucuacuagaggcaguucacgacaccaucauugcaaaggcugauccaccuagcugugaccuucagagugcucaugggaaucccuguaugaaagagaaacuugugaugaagacacauuguccaaaugacuaccagucagcucauuaccucaacaaugacgggaaaauggcuucagucaagugcccaccuaaguaugagcucacugaggacugcaacuuuuguagacagaugacaggugcuagccugaagaaggggucuuauccucuccaagacuuauuuugucagucaagugaggaugauggaucaaaauugaaaacaaaaaugaaaggggucugcgaaguggggguucaagcacucaaaaagugugauggccaacucagcacugcacaugagguugugcccuuugcaguguuuaaaaacucacagaagguuuaucuugauaaacuugaccucaagacugaggagaaucugcuaccagacucauuugucugcuucgagcauaagggacaguauaaaggaacaauggacucuggucagaccaagagggagcucaaaagcuuugauaucucucagugccccaagauuggagggcaugguaggaagaagagaacuggggacgcagcauuuugcucugcuuaugaaugcacugcucaguaugccaaugccuauuguucacgugccaacgggucagggauugugcagauucaaguaucaagggucuggaagaagccuuuauguguaggguaugagagagugguugugaagagagaacucucugccaaacccauccagagaguugagccuugcacaacuuguauaaccaaaugugagccucauggauugguuguccgaucaacaggguucaagauaucaucugcaguugcuugugcuagcgggguuugcgucacagggucgcagaguccuucuacugagauuacacucaaguauccagggauaucccaguccucugggggggacauagggguucacauggcacacgaugaucagucaguuagcuccaaaauaguagcucacugcccuccccaggacccgugcuuagugcauggcugcauagugugugcucauggccugauaaauaaccagucacacucugcucucagugccuuuguugucauauuuguauucaguucuacugcaauaauuugcuuagcuguucuuuauagggugcucaagugcuuaaagauugccccaaggaaaguccugaauccacuaauguggauuacagccuucaucagauggguguauaagaagaugguugcuagaguggcagacaauauuaaucaagugaacagagaaauaggauggauggaaggaggucaguuggcucuagggaacccugccccuauuccucgucaugccccaaucccacguuauagcacauaccuaaugcuacuauugauugucucauaugcaucagca

SEQ ID NO: 4616 - RNA, 1521 nt, Artificial Sequence
  derived and/or modified CDS sequence (wt) from RVFV(ZH-548)__DQ380206.1__Gc
uguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccuca

SEQ ID NO: 4617 - RNA, 1521 nt, Artificial Sequence
  derived and/or modified CDS sequence (wt) from RVFV(35/74)__JF784387.1__Gc
uguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagggagggccagagcuauuggacuggguccuuuagcccuaaaugucugagcucaaggagaugccaucuugucggggaaugucaugugaauaggugucugucuuggagagacaaugaaaccucagcagaauuuucauuuguuggggaaagcacgaccaugcgggagaacaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuuccuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaucuuauuucauacaagcccaugauagaucaguuggagugcacaacaaaucugauugaucccuuuguugucuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagauggaucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuucuuauauaucuuggaagaacaggccucucuaaaauguggcuugcugccaccaagaaagccuca

SEQ ID NO: 4618 - RNA, 1521 nt, Artificial Sequence
  derived and/or modified CDS sequence (wt) from RVFV(200803162)__JF311377.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4619 - RNA, 1521 nt, Artificial Sequence
  derived and/or modified CDS sequence (wt) from RVFV(200803166)__JF311381.1__Gc
uguucagaacugauucaggcaagcuccagaaucaccacuugcuccacagagggugucaacaccaaguguagacugucuggcacagcauugaucagggcagggucaguuggggcagaggcuuguuugauguugaaggggguuaaggaagaucaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagucucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauguaguucucccaucagagaaugggacaaaagaucagugucagauacugcauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4620 - RNA, 1521 nt, Artificial Sequence
  derived and/or modified CDS sequence (wt) from RVFV(SA-51 (Van Wyck))__DQ380195.1__Gc
ugcucagaacugauucaggcaagcuccagaaucaccacuugcucuacagaaggugucaacaccaaguguaggcugucuggcacagcauuaaucagggcagggucaguuggggcagaggcuuguuugauguugaagggggucaaggaagaccaaaccaaguucuugaagauaaaaacugucucaagugagcuaucgugcagggagggccagagcuauuggacuggguccuuuagccccaagugucugagcucaaggagaugccaucuugucggggaaugucaugugaauaggugucugucuuggagggauaaugaaacuucagcagaguuuucauuuguuggggaaagcacgaccaugcgagaaaauaaguguuuugagcaguguggaggauggggauguggguguuucaaugugaacccaucuugcuuauuugugcacacguaucugcagucaguuagaaaagaggcccuuagaguuuuuaacuguaucgauugggugcauaaacucacucuggaggucacagauuuugauggcucuguuucaacaauagacuugggagcaucaucuagccguuucacaaacugggguucaguuagccucucacuggaugcagagggcauuucaggcucaaauagcuuuucuuucauugagagcccaggcaaaggguaugcaauuguugaugagccauucucagaaauuccucggcaaggguucuugggggagaucaggugcaauucagaaucuucaguucugagugcccacgaaucaugccuuagggcaccaaaccuuaucucauacaagcccaugauagaucaguuggagugcacaacaaaucugauugaucccuuuguugucuuugagagggguucccugccacagacaaggaaugacaaaaccuuugcagcuucaaaaggaaacagggguguucaagcuuucucuaagggcucuguacaagcugaucuaacucugauguuugacaauuuugagguggacuuugugggagcagccgugucuugugaugcugccuucuuaaauuugacagggugcuauucuugcaaugcaggggccagggucugccugucuaucacauccacaggaacuggaacccucucugcccacaauaaggaugggucucugcauauaguucuuccaucagagaauggaacaaaagaucagugucagauacuacacuucacuguuccugaaguagaggaagaguuuauguacucuugugauggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuucuuauauaucuuggaagaacaggucuuucuaaaauguggcuugcugcuacuaagaaggccuca

SEQ ID NO: 4621 - RNA, 1521 nt, Artificial Sequence
  derived and/or modified CDS sequence (wt) from RVFV(ZINGA J83 R1)__KU978776.1__Gc
uguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcacaacaaaucugauugaccccuuuguuguauuugagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccuca

SEQ ID NO: 4622 - RNA, 1521 nt, Artificial Sequence
  derived and/or modified CDS sequence (wt) from RVFV(Entebbe)__DQ380191.1__Gc
uguucagaacuaauucaggcaagcuccagaaucaccaccugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugagacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugucugucuaucacaucuacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaacuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuuca

SEQ ID NO: 4623 - RNA, 1521 nt, Artificial Sequence
  derived and/or modified CDS sequence (wt) from RVFV(Sudan 2V-2007)__JQ820490.1__Gc
uguucagaacuuauucaggcaagcuccagaaucaccacuugcuccacagagggugucaacaccaaguguagacugucuggcacagcauugaucagggcagggucaguuggggcggaggcuuguuugauguugaagggggucaaggaagaucaaacuaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaauguaaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguuuuugggggagaucaggugcaauucagaguccucaguccuaagugcucaugaaucaugccuuagggcgccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaagacgggucucugcauauaguucucccaucagagaaugggacaaaagaucagugucagauacuacauuuuacuguaccugaaguagaagaggaguuuauguacucuugugauggagaugagcggccucuguuaguaaaagggacccugauggcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4624 - RNA, 1521 nt, Artificial Sequence
  derived and/or modified CDS sequence (wt) from RVFV(Sudan 86-2010)__JQ820489.1__Gc
uguucagaacugauucaggcaaguuccagaaucaccacuugcuccacagagggugucaacaccaaguguagacugucuggcacagcauugaucagggcagggucaguuggggcggaggcuuguuugauguugaagggggucaaggaagaucaaaccaaguucuuaaagauaaaaacugucucaagugagcuaucgugcagggagggccagagcuauuggacuggguccuucagccccaagugccugagcucaaggagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguuaucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaaucugacagguugcuauucuugcaaugcaggggccagaguuugccugucuaucacauccacaggaacugggacucucucugcccacaauaaggacgggucucugcauauaguucucccaucagagaaugggacaaaagaucagugucagauacuacauuucaccguaccugaaguagaagaggaguuuauguacucuugugauggagaugagcggccucuguuagugaaagggacccugauagcuauugacccauuugaugauaggcgggaggcugggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccuca

SEQ ID NO: 4625 - RNA, 1521 nt, Artificial Sequence
  derived and/or modified CDS sequence (wt) from RVFV(Kenya 56 (IB8))__DQ380190.1__Gc
uguucagaacugauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccaaaccaaguuuuugaagauaaaaacugucucaagugagcuaucgugcagagagggccagagcuauuggacuggguccuuuagcccuaaaugucugagcucaaggaggugccaucuugucggggaaugucaugugaauaggugucugucuuggagagacaaugaaacuucagcagaauuuucauuuguuggggaaagcacgaccaugcgggagaauaaguguuuugagcaguguggaggauggggauguggguguuucaaugugaacccaucuugcuuauuugugcacacguaucugcagucagucagaaaagaggcccuuagaguuuucaacuguaucgauugggugcauaaacucacucuagagauuacugacuuugauggcucuguuucaacaauagaccugggagcaucaucuagccguuucacaaacugggguucaguuagccucucacuggacgcagagggcauuucaggcucaaacagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaaucugauugaucccuuuguugccuuugagaggggcucucugccacagacaaggaaugacaaaaccuuugcagcuucaaaaggaaauagggguguucaagcuuucucuaagggcucuguacaggcugaucuaacacugauguuugacaauuuugagguggacuuugugggagcagccgugucuugugaugccgccuucuuaaauuugacagguugcuauuccugcaaugcaggggccagagucugccugucuaucacauccacaggaacuggaacucucucugcccacaauaaagaugggucucugcauauaguucuuccaucagagaauggaacaaaagaucagugucagauacuacacuucacuguaccugagguagaggaggaguuuauguacucuugugauggagaugagcggccucuguuggugaagggaacccugauagcuauugauccauuugaugauaggcgagaagcagggggggaaucaacaguugugaauccaaaaucuggaucuuggaauuucuuugacugguuuucuggacucaugaguugguuuggagggccucuuaagacuauacuccucauuugccuguauguagcauuaucaauugggcucuuuuuccuccuuauauaucuuggaagaacaggccucucuaaaauguggcuugcugccaccaagaaagccuca

SEQ ID NO: 4626 - RNA, 1521 nt, Artificial Sequence
  derived and/or modified CDS sequence (wt) from RVFV(ARD-38388)__DQ380187.1__Gc
uguucagaacugauucaggcaagcuccagaauaaccacuugcuccacagaaggugucaacaccaaguguaggcugucuggcacagcauuaaucagggcagggucaguuggggcagaggcuugcuugauguugaagggggucaaggaagaccaaacaaaguucuuaaagauaaaaacugucucaagugagcuaucgugcagggaaggccagagcuauuggacuggauccuuuagucccaaaugucugagcucaaggagaugccaucuagucggggaaugucaugugaacaggugucugucuuggagggacaaugaaacuucagcagaguuuucauuuauuggggaaagcacgacuaugcgagagaauaaauguuuugagcaguguggaggauggggauguggaugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaaucccucggcaaggguucuugggggagaucaggugcaauucagaaucuucaauccugagugcucaugaaucaugccuucgggcaccaaaccucaucucauacaagcccaugauagaccaguuggagugcacaacaaaucugauugaucccuuuguugucuuugagagggguucccugccucagacaaggaaugauaaaaccuuugcagcuucaaaaggaaauagggguguucaagccuucucuaagggcucuguacaagcugauuuaacucugauguuugacaauuuugagguggacuuugugggagcagccgugucuugugaugcagccuucuuaaaucugacagguuguuauucuugcaaugcaggggccagagucugccugucuaucacauccacaggaacugggacucucucugcccauaauaaggaugggucucugcauauaguucuuccaucagagaauggaacaaaagaucagugucagauacuacacuucacuguaccugagguagaggaggaguuuauguacucuugugauggggaugagcggccucuguuggugaaggggacccugauugcuauugauccauuugaugauaggcgggaagcaggaggggaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucuuauauaucuuggaagaacaggucucucuaaaauguggcuugcugcuacuaagaaggccuca

SEQ ID NO: 4627 - RNA, 1521 nt, Artificial Sequence
  derived and/or modified CDS sequence (wt) from RVFV(Sudan 28-2010)__JQ820491.1__Gc
uguucagaacugauucaggcaagcuccagaaucaccacuugcucuacagagggugucaacaccaaguguagacugucuggcacagcauugaucagggcagggucaguuggggcggaggcuuguuugauguugaagggggucaaggaagaucaaaccaaguucuuaaagauaaaaacuguuucaagugagcuaucgugcagggagggccagagcuauuggacuggguccuuuagccccaagugccugagcucaagaagaugccaucuugucggagaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguuguauuaucaauugggcucuucuuccuccuuauauaucuuggaagaacaggccucucuaaaauguggcuugcugcuacuaagaaggccuca

SEQ ID NO: 4628 - RNA, 1521 nt, Artificial Sequence
  derived and/or modified CDS sequence (wt) from RVFV(200803167)__JF311382.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuucgagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuaugcuccucauuugccuguauguugcauuaucaauugggcucuucuuccuccuuauauaucuuggaagaacaggccucucuaaaauguggcuugccgcuacuaagaaggccuca

SEQ ID NO: 4629 - RNA, 1521 nt, Artificial Sequence
  derived and/or modified CDS sequence (wt) from RVFV(73HB1230)__DQ380221.1__Gc
uguucagaacugauucaggcaagcuccagaaucaccacuugcuccacagaggguguuaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaaaugucugagcucaaggagaugccaucuuguuggagagugucaugugaauaggugucugucuuggagggacaaugaaacuucagcagaguuuucauuuguuggggaaagcacgaucaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacgacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagcuguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuguuggugaaagggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugucuguauguugcauuaucaauugggcucuuuuuccuccuuauauaucuuggaagaacaggccucucuaaaauguggcuugcugcuacuaagaaggccuca

SEQ ID NO: 4630 - RNA, 1521 nt, Artificial Sequence
  derived and/or modified CDS sequence (wt) from RVFV(2250/74)__DQ380209.1__Gc
uguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaguguggaggauggggguguggguguuuuaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccaaggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccuca

SEQ ID NO: 4631 - RNA, 1521 nt, Artificial Sequence
  derived and/or modified CDS sequence (wt) from RVFV(SAUDI 200010901)__KU978778.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggagucaaggaagaucaaaccaaguucuuaaagauaaaaacugucucuagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggacgggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4632 - RNA, 1521 nt, Artificial Sequence
  derived and/or modified CDS sequence (wt) from RVFV(Lunyo)__KU167026.1__Gc
uguucagaacugauucaggcaagcuccagaaucaccacuugcuccacagaaggugucaacaccagguguaggcugucuggcacagcauuaaucagggcagggucaguuggggcagaggcuuguuugauguuaaagggggucaaggaagaccaaaccaaguucuugaagauaaaaacugucucaagugagcuaucgugcagggagggccagagcuauuggacuggauccuuuagccccaaaugucugagcucaaggagaugccaucuugucggggaaugucaugugaauaggugucugucuuggagggacaaugaaacuucagcagaauuuucauuuguuggggaaagcacgacuaugcgagagaauaaauguuuugagcaguguggaggauggggauguggguguuucaaugugaacccaucuugcuuauuugugcacacguaucugcagucaguuagaaaagaggcccuuagaguuuucaacuguaucgauugggugcauaaacucacucuagagauuacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucaguccugagugcucaugaaucaugccuuagggcaccaaaccuuauuucauacaagcccaugauagaucaguuggagugcacaacaaauuugauugaucccuuuguugucuuugagagggguucucuaccacagacaaggaaugacaaaaccuuugcagcuucaaaaggaaauagggguguucaagcuuucucuaagggcucuguacaagcugaccuaacucugauguuugacaauuuugagguggacuuugugggggcagccgugucuugugaugccgccuucuuaaauuugacagguugcuauuccugcaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacucaugaguugguuuggagggccccuuaagacuauacuccuuauuugccuguauguagcauuaucaauugggcucuuuuuccuucuuauauaucuuggaagaacaggucucucuaaaauguggcuugcugccacuaagaaagccuca

SEQ ID NO: 4633 - RNA, 1521 nt, Artificial Sequence
  derived and/or modified CDS sequence (wt) from RVFV(25010-24)__KM210509.1__Gc
uguucagaacugauucaggccagcuccagaaucacuacuugcuccacagaagguguuaacacuaaguguaggcugucuggcacagcauugaucagggcaggaucaguuggagcagaagcuugucugauguuaaagggggucaaggaugaccaaaccaaguuccugaagauaaaaacugucucaagugagcuaucgugcagggagggccagagcuauuggacuggguccuucagccccaaaugucugagcucaaggaggugccaucuugucggggaaugucaugugaauaggugucugucuuggagggacaaugagacuucagcagaauuuucauuuguuggggaaagcacgaccaugcgagagaacaaguguuuugagcaguguggaggauggggauguggguguuucaacguaaacccaucuugcuuguuugugcacacguaucuacagucagucagaaaagaggcccuuagaguuuuuaacugcauugauugggugcauaaacuuacucuagagaucacagacuuugauggcucuguuucaacaauagacuugggagcuucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggauucuuaggagagaucaggugcaauucagaaucuucaguucugagugcucaugaaucaugccuuagggcgccaaaccuuaucucauacaaaccaaugauagaucaguuggagugcacaacaaaucuaauugauccuuuuguagucuuugagagggguucccugccacaaacaaggaaugacaaaaccuuugcagcuucaaaagggaauagggguguucaagcuuucucuaagggcucuguacaagcugaucuaacucugauguuugacaauuuugagguggacuucgugggagcagccgugucuugugaugccgccuucuugaauuugacagguugcuauucaugcaaugcaggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaagggacccugauagcuauugauccauuugaugauaggcgagaagcagggggggaaucaacaguugugaauccaaaaucuggaucuuggaauuucuuugacugguuuucuggacucaugaguugguuuggagggccucucaagacuauacuccuaauuugccuguauguagcauuaucaauugggcucuuuuuccuucuuauauaucuugggagaacaggucucucuaaaauguggcuugcugcuacuaagaaggccuca

SEQ ID NO: 4634 - RNA, 1521 nt, Artificial Sequence
  derived and/or modified CDS sequence (wt) from RVFV(2007000253)__JF326192.1__Gc
uguucagaacugauucaggcaagcuccagaaucaccacuugcuccacagagggugucaacaccaaguguagacugucuggcacagcauugaucagggcagggucagcuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4635 - RNA, 1521 nt, Artificial Sequence
  derived and/or modified CDS sequence (wt) from RVFV(ZC-3349)__DQ380207.1__Gc
uguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuaaggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccuaucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaaccauacuccucauuugccuguauguugcauuaucaauugggcucuuuuuccuccuuauauaucuuggaagaacaggccucucuaaaauguggcuugcugccacuaagaaggccuca

SEQ ID NO: 4636 - RNA, 1521 nt, Artificial Sequence
  derived and/or modified CDS sequence (wt) from RVFV(OS-1)__DQ380186.1__Gc
uguucagaacugauucaggcaagcucuagaauaaccacuugcucuacagaaggugucaacaccaaguguaggcugucuggcacagcauuaaucagggcagggucaguuggggcagaggcuugcuugauguuaaagggagucaaggaggaccaaacaaaguucuugaagauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuaaaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugacagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccuca

SEQ ID NO: 4637 - RNA, 1521 nt, Artificial Sequence
  derived and/or modified CDS sequence (wt) from RVFV(KEN/Gar-004/06)__HM586964.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagauuacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4638 - RNA, 1521 nt, Artificial Sequence
  derived and/or modified CDS sequence (wt) from RVFV(Smithburn)__DQ380193.1__Gc
uguucagaacuaauucaggcaagcuccagaaucaccacuugcuccacagaaggugucaacaccaagugcaggcugucuggcacagcauuaaucagggcagggucaguuggggcagaggcuuguuugauguuaaagggggucaaggaagaccagaccaaguucuugaagauaaaaacugucucaagugagcuaucauguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugaacaguguggaggauggggauguggguguuucaaugugaacccaucuugcuuauuugugcacacguaucugcagucaguuagaaaagaagcccuuagaguuuuuaacuguauugauugggugcauaaacugacucuagagauuacagacuuugauggcucuguuucaacaguagacuugggagcaucaucuagccguuucacaaacugggguucagucagccucucacuggacgcagagggcauuucaggcucaaauagcuucucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcuuuuuuucuuucuuauauaucuuggaagaacaggucucucuaaaauguggcuugcugccacuaagaaagcuuca

SEQ ID NO: 4639 - RNA, 1521 nt, Artificial Sequence
  derived and/or modified CDS sequence (wt) from RVFV(2008/00101)__HE687306.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcauucucuaagggcucuguacaagcugaucugacucugauguuugauaauuuugagguggacuuugugggagcagccgugucuugugaugccgccuucuugaauuugacagguugcuauucuugcaaugcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuacacuccucauuugccuguauguugcauuaucaauugggcucuucuuccuccuuauauaucuuggaagaacaggccucucuaaaauguggcuugccgcuacuaagaaggccuca

SEQ ID NO: 4640 - RNA, 1521 nt, Artificial Sequence
  derived and/or modified CDS sequence (wt) from RVFV(2007001292)__EU574046.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggauccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaaucucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4641 - RNA, 1521 nt, Artificial Sequence
  derived and/or modified CDS sequence (wt) from RVFV(2007002445)__EU574037.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuauacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4642 - RNA, 1521 nt, Artificial Sequence
  derived and/or modified CDS sequence (wt) from RVFV(Ken 199800523)__KU978777.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugucugagcucaaggagaugccaucuugucggggaaugucaugugaauaggugucugucuuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagaaauuccucggcaaggguucuugggggagaucaggugcaauucagaguccucaguccugaaugcucaugaaucaugccuuagggcaccaaaccuuaucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguuguuauuccugcaaugcaggggccagagucugccugucuaucacauccacaggaacuggaacucucucugcccacaauaaggaggggucucugcauauaguucucccaucagagaaugggacaaaagaucagugucagauacuacauuucacugugccugaaguagaagaggaguuuauguacucuugugauggagaugagcggccucuguuagugaaagggacccugauagcuauugacccauuugaugauaggcgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4643 - RNA, 1521 nt, Artificial Sequence
  derived and/or modified CDS sequence (wt) from RVFV(clone 13)__DQ380213.1__Gc
uguucagaacugauucaggcaagcuccagaaucaccacuugcuccacagagggugucaacaccaaguguagacugucuggcacagcauugaucagggcagggucaguuggggcagaggcuugucugauguugaagggggucaaggacgaucaaaccaaguucuuaaagauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacuaacacuagagaucacagacuuugauggcucuguuucaacaauagaccuaggagcaucaucuagccguuucacaaacugggguucagucagccucucacuggacgcagagggcauuucaggcucaaauagcuuuucuuucauugagagcccaggcaaaggguaugcaauuguugaugagccauucucagaaauuccucggcaaggguuccugggggagaucaggugcaauucagaguccucaguccugagugcucaugaaucaugccuuagggcaccaaaccuuaucucauacaagcccaugauagaccaauuggagugcacaacgaaucugauugauccauuuguugucuuugagagggguucucugccacagacaaggaaugaaaaaaccuuugcagcuucaaaaggaaauagagguguccaagccuucucuaagggcucuguacaagcugaucuaacucugauguuugacaauuuugagguggauuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucaaugccagauacuacacuucacuguaccugagguagaggaggaguuuauguacucuugugacggagaugagcggccucuguuggugaaggggacccugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccuuauuugccuguauguugcauuaucaauugggcucuuuuuccuccucauauaucuuggaagaacaggccucucuaaaauguggcuugcugcuacuaagaaggccuca

SEQ ID NO: 4644 - RNA, 1521 nt, Artificial Sequence
  derived and/or modified CDS sequence (wt) from RVFV(2373/74)__DQ380194.1__Gc
uguucagaacugauucaggcaagcuccagaaucaccaccugcuccacagaaggugucaacaccaaguguaggcugucuggcacagcauuaaucagggcagggucaguuggggcagaggcuuguuugauguuaaagggggucaaagaagaccaaaccaaguucuugaagauaaaaacugucucaagugagcuaucgugcagggaaggccagagcuauuggacuggguccuuuagccccaaaugccugagcucaaggaggugccaucuugucggggaaugucaugugaauaggugucugucuuggagggacaaugaaacuucugcagaauuuucauuuguuggggaaagcacgaccaugcgagagaauaaguguuuugagcaguguggaggauggggauguggguguuucaaugugaauccaucuugcuuauuugugcacacguaucugcagucgguuagaaaagaggcccuuagaguuuucaacuguauugauugggugcauaaacucacucuagagaucacagacuuugauggcucuguuucaacauuagacuugggagcaucaucuagccguuucacaaacugggguucgguuagccucucacuggaugcagagggcauuucaggcucaaauagcuuuucuuucauugagagcccaggcaaaggguaugcaauuguugaugagccauucucagaaauuccucggcaaggguucuugggagagaucaggugcaauucagaaucuucaguccugagugcucaugaaucaugccuuagggcaccaaaccuuaucucauacaagccuaugauagaucaguuggagugcacaacaaaucugauugaucccuuuguugucuuugagagggguucucugccacagacaaggaaugaaaaaaccuuugcagcuucaaaaggaaauagggguguucaagcuuucuccaagggcucuguacaagcugaucuuacucugauguuugacaauuuugagguggacuuugugggagcagccgugucuugugaugccgccuucuuaaauuuaacagguugcuauuccugcaaugcaggagccagagucugcuugucuaucacauccacaggaacuggaacucucucugcccacaauaaggaugggucucugcacauaguucuuccaucagagaauggaacaaaagaucagugucagauacuacacuucacuguaccugagguggaggaggaguuuauguacucuugugauggagaugagcggccucuauuggugaaggggacccugauagcuauugauccauuugaugauaggcgagaagcaggaggggaaucaacaguugugaauccaaaaucugguucuuggaauuucuuugacugguuuucuggacuuaugaguugguuuggagggccucuuaagaccauacuccuaauuugccuguauguggcauuaucaauugggcucuuuuuccuccuuauauaucuuggaagaacaggucucucuaaaauguggcuugcugccacuaagaaagccuca

SEQ ID NO: 4645 - RNA, 1521 nt, Artificial Sequence
  derived and/or modified CDS sequence (wt) from RVFV(OS-8)__DQ380185.1__Gc
uguucagaacugauucaggcaagcucuagaauaaccacuugcuccacagaaggugucaacaccaaguguaggcugucuggcacagcauuaaucagggcagggucaguuggggcagaggcuugcuugauguuaaagggagucaaggaggaccaaacaaaguucuugaggauaaaaacugucucaagugagcuaucgugcagggaaggccagagcuauuggacuggauccuuuagucccaaaugucugagcucaaggagaugccaucuugucggggaaugucaugugaauaggugucugucuuggagggacaaugaaacuucagcagaguuuucauuuguuggggaaagcacgacuaugcgagagaauaaauguuuugagcagugugggggauggggaugugggugcuucaaugugaacccaucuugcuuguuugugcacacguaucugcagucaguuagaaaagaggcccuuagaguuuuuaacuguaucgauugggugcauaaacucacucuagagaucacagacuuugaugguucuguuucaacaauagacuugggagcaucaucuagccguuucacaaacuggggcucaguuagccucucacuggaugcagagggcauuucaggcucaaauagcuuuucuuucauugagagcccaggcaaaggguaugcaauuguugaugagccauucucagaaaucccucggcaaggguucuugggggagaucaggugcaauucagaaucuucaguccugagugcucaugaaucaugccuucgggcaccaaaccucaucucauacaagcccaugauagaccaguuggagugcacaacaaaucugauugaucccuuuguugucuuugagagggguucucugccucagacaaggaaugauaaaacuuuugcagcuucaaaaggaaauagggguguucaagcuuucucuaagggcucuguacaagcugauuuaacucugauguuugacaauuuugagguggacuuugugggagcagccgugucuugugaugccgcuuucuuaaaucugucagguuguuauucuuguaaugcaggggccagagucugccugucuaucacauccacaggaacuggaacucucucugcccacaauaaggaugggucucugcauauaguucuuccaucagagaauggaacaaaagaucagugucagauacuacacuucacuguaccugagguagaggaggaguuuauguacucuugugauggagaugagcggccucuguuggugaaggggacccugaucgccauugauccauuugaugacaggcgggaagcagggggagaaucaacaguugugaauccaaaaucuggaucuuggaauuucuuugacugguuuucuggacucaugaguugguuuggagggccucuuaagacuauacuccucauuugccuguauguugcauuaucaauugggcucuuuuuccuucucauauaucuuggaagaacaggucucucuaaaauguggcuugcugcuacuaagaaggccuca

SEQ ID NO: 4646 - RNA, 1521 nt, Artificial Sequence
  derived and/or modified CDS sequence (wt) from RVFV(KEN/Bar-035/07)__HM586969.1__Gc
uguucagaacugauucaggcaagcuccagaaucaccacuugcuccacagagggugucaacaccaaguguagacugucuggcacagcauugaucagggcacggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggauaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaacgcaggggccagagucugccuguccaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4647 - RNA, 1521 nt, Artificial Sequence
  derived and/or modified CDS sequence (wt) from RVFV(MgH824)__DQ380210.1__Gc
uguucagaacugauucaggcaagcuccagaaucaccacuugcucuacagaggguguugacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacaaccaugcgagagaauaaguguuuugagcaguguggaggauggggguguggguguuucaaugugaacccaucuugcuuauuugugcacacguaucugcagucaguuagaaaagaggcccuuagaguuuuuaacuguaucgacuggguacauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucccagagauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaccccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacauuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaaggacaggccucucuaaaauguggcuugcugccacuaagaaggccuca

SEQ ID NO: 4648 - RNA, 1521 nt, Artificial Sequence
  derived and/or modified CDS sequence (wt) from RVFV(200803169)__JF311384.1__Gc
uguucagaacugauucaggcaagcuccagaaucaccacuugcuccacagagggugucaacaccaaguguagacugucuggcacagcauugaucagggcagggucaguuggggcagaggcuuguuugauguugaagggggucaagguagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagauuccucggcaaggguucuugggggaggucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4649 - RNA, 1521 nt, Artificial Sequence
  derived and/or modified CDS sequence (wt) from RVFV(2007001811)__EU574040.1__Gc
uguucagaacugauucaggcaagcuccagaaucaccacuugcuccacagagggugucaacaccaaguguagacugucuggcacagcauugaucagggcagggucaguuggggcggaagcuuguuugauguugaagggggucaaggaagaucaaaccaaguucuuaaugauaaaaacugucucaagugagcuaucgugcagggagggccagagcuauuggacuggguccuuuagccccaagugccugagcucaagaagaugccaucuugucggggaaugucaugugaauaggugucuguccuggagggacaaugaaacuucagcagaguuuucauuuguuggggaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauaguuuuucuuuuauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucguacaagcccaugauagaucaauuggagugcacuacaaaucugauugaucccuuuguugucuuugagagggguucucugccacagacaaggaaugaaaaaaccuuugcagcuucaaaaggaaauagagguguucaggcuuucucuaagggcucuguacaagcugaucugacucugauguuugauaauuuugagguggacuuugugggagcagccgugucuugugaugccgccuucuugaauuugacagguugcuauucuugcaaugcaggggccagagucugccugucuaucacauccacaggaacugggacucucucugcccacaauaaggacgggucucugcauauaguucucccaucagagaaugggacaaaagaucagugucagauacuacauuucacuguaccugaaguagaagaggaguuuauguacucuugugauggagaugagcggccucuguuagugaaagggacccugauagcuauugacccauuugaugauaggcgggaggcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugcugcuacuaagaaggccuca

SEQ ID NO: 4650 - RNA, 1521 nt, Artificial Sequence
  derived and/or modified CDS sequence (wt) from RVFV(Kenya 57 (Rintoul))__DQ380192.1__Gc
uguucagaacuaauucaggcaagcuccagaaucaccacuugcuccacagaaggugucaacaccaaguguaggcugucuggcacagcauuaaucagggcagggucaguuggggcagaggcuuguuugauguuaaagggggucaaggaagaccagaccaaguucuugaagauaaaaacugucucaagugagcuaucguguagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguauugauugggugcauaaacucacucuagagaucacagacuuugauggcucuguuucaacaguagacuugggagcaucaucuagccguuucacaaacugggguucaguuagccucucacuggacgcagagggcauuucaggcucaaauagcuucucuuucauugagagcccaggcaaaggguaugcaauuguugaugagccauucucagaaauuucucggcaaggguucuugggagagaucaggugcaauucagaaucuucaguccugagugcucaugaaucaugccuuagggcaccaaaccuuaucucauacaaacccaugauagaucaguuggagugcacaacaaaucugauugaucccuuuguugucuuugagagggguucucugccucagacaaggaaugacaaaaccuuugcagcuucaaaaggaaauagggguguucaagcuuucucuaagggcucuguacaagcugaucuaacucugauguuugacaauuuugagguggacuuugugggagcagccgugucuugugaugccgccuucuuaaacuugacagguugcuauuccugcaaugcaggggccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguuuauguacucuugugauggagaugagcggccucuguuggugaaggggacccugauagcuauugauccauuugaugauaggcgagaagcagggggggaaucaacaguugugaauccaaaaucuggaucuuggaauuucuuugacugguuuucuggacuuaugaguugguuuggagggccucuuaagacuauacuccuaauuugccuguauguagcauuaucaauugggcucuuuuuccuucuuauauaucuuggaagaacaggucucuccaaaauguggcuugcugccacuaagaaagcuuca

SEQ ID NO: 4651 - RNA, 1521 nt, Artificial Sequence
  derived and/or modified CDS sequence (wt) from RVFV(Beijing-01)__KX611606.1__Gc
uguucagaacugauucaggcaagcuccagaaucaccacuugcuccacagaaggugucaacaccaaguguaggcugucuggcacagcauuaaucagggcagggucaguuggggcagaggcuuguuugauguuugagggggucaaggaagaccagaccaaguucuuaaagauaaaaacugucucaagugagcuaucgugcagggagggccagagcuauuggacuggguccuuuagccccaaaugucugagcucaaggagaugccaucuugucggagaaugucaugugaauaggugucugucuuggagggacaaugaaacuucagcagaauuuucauuuguuggggaaagcacgaccaugcgagagaauaaguguuuugagcaguguggaggauggggauguggauguuucaaugugaacccaucuugcuuauuugugcacacguaucugcaaucaguuagaaaagaggcucuuagaguuuuuaacuguauugauugggugcauaaacucacucuagagaucacagacuuugauggcucuguuucaacaauagacuugggagcaucaucuagccguuucacaaacuggggcucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaaucuucuguccugagugcucaugagucaugccuuagggcaccaaaccuuaucucauacaaacccaugauagaucaguuggagugcacaacaaaucugauugaucccuuuguugucuuugagaggggaucucugccacagacaaggaaugacaaaaccuuugcagcuucaaaaggaaauagggguguucaagcuuucucuaaaggcucuguacaggcugaucuaacucugauguuugacaauuuugagguggacuuugugggagcagccgugucuugugaugccgccuucuuaaauuugacagguugcuauuccugcaaugcuggagccagagucugccugucuaucacauccacaggaacuggaacucuuucugcccacaauaaggaugggucucugcauauaguucuuccaucagagaauggaacaaaagaucagugucagauacuacacuucacuguaccugagguggaggaggaguucauguacucuugugauggagaugagcgaccuuuguuggugaaggggacccuaauagcuauugauccauuugaugauaggcgagaagcagggggagaaucaacaguugugaauccaaaaucuggaucuuggaacuucuuugacugguuuucuggacuuaugaguugguuuggaggaccucuuaagacuauacuccuaauuugccuguauguagcauuaucaauugggcucuuuuuccuucuuauauaucuuggaagaacaggucucucuaaaauguggcuugcugccacuaagaaagccuca

SEQ ID NO: 4652 - RNA, 1521 nt, Artificial Sequence
  derived and/or modified CDS sequence (wt) from RVFV(ANK-6087)__DQ380216.1__Gc
uguucagaacugauucaggcaagcuccagaaucacuacuugcuccacagagggugucaacaccaaguguagacugucuggcacagcauugaucagggcagggucaguuggggcagaggcuuguuugauguugaagggggucaaggaagaucaaaccaaguucuuaaaaauaaaaacugucucaagugagcuaucgugcagggagggccagagcuauuggacuggguccuuuagccccaaaugucugagcucaaggagaugccaucuugucggggaaugucaugugaauaggugucugucuuggagggacaaugaaacuucagcagaguuuucauuuguuggagaaagcacgaccaugcgagagaauaaguguuuugagcaguguggaggauggggauguggguguuucaaugugaacccaucuugcuuauuugugcacacguaucugcagucaguuagaaaagaggcccuuagaguuuuuaacuguaucgacugggugcauaaacucacucuggagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugagucaugccuuagggcaccaaaccuuaucucauacaagcccaugauagaucaauuggagugcucaacaaaucugauugaccccuuuguuguauuuaagagggguucucugccacagacaaggaaugacaaaaccuuugcugcuucaaaaggaaauagagguguucaagcuuucucuaagggcucugugcaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaacucucucugcccacaauaaggaugggucucugcauauaguucuuccaucagagaauggaacaaaagaucagugucagauacuacacuucacuguaccugaaguagaggaggaguuuauguacucuugugauggagaugagcggccucuauuggugagggggacucugauagcuauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugcuuguauguugcauuaucaauugggcucuuuuuccuccucauauaucuuggaagaacaggccucucuaaaauguggcuugcugcuacuaagaaggccuca

SEQ ID NO: 4653 - RNA, 1521 nt, Artificial Sequence
  derived and/or modified CDS sequence (wt) from RVFV(MP12)__Z30318.1__Gc
uguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaaguuaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaggaacaggccucucuaaaauguggcuugcugccacuaagaaggccuca

SEQ ID NO: 4654 - RNA, 1521 nt, Artificial Sequence
  derived and/or modified CDS sequence (wt) from RVFV(KEN/Bar-032/07)__HM586968.1__Gc
uguucagaacugauucaggcaagcuccagaaucaccacuugcuccacagagggugucaacaccaaguguagacugucucacacagcauugaucagggcagggucaguuggggcagaggcuuguuugauguugaagggggucaaggaagaucaaaccaaguucuuaaagauaaaaacugucucaagugagcuaucgugcagggagggccagagcuauuggacuggguccuuuagccccaagugccugagcucaaggagaugccaucuugucggggaaugucaugugaauaggugucugucuuggagggacaaugaaacuucagcagaguuuucauuuguuggagaaagcacaaccaugcgagagaauaaguguuuugagcaguguggaggauggggguguggauguuucaaugugaacccuucuugcuuauuugugcacacguaucugcagucaguuagaaaagaggcccuuagaguuuuuaacuguaucgacugggugcauaaacucacucuagagaucacagacuuugauggcucuguuucaacaauagacuuaggagcaucaucuagccguuucacaaacugggguucaguuagccucucacuggacgcagagggcauuucaggcucaaauagcuuuucuuuuauugagagcccaggcaaaggguaugcaauuguugaugagccauucucagagaucccucggcaaggguucuugggggagaucaggugcaauucagaguccucaguccugagugcucaugaaucaugccuuagggcaccaaaccuugucucguacaagcccaugauagaucaauuggagugcacuacaaaucugauugaucccuuuguugucuuugagagggguucucugccacagacaaggaaugacaaaaccuuugcagcuucaaaaggaaauagagguguucaggcuuucucuaagggcucuguacaagcugaucugacucugagguuugauaauuuugagguggacuuugugggagcagccgugucuugugaugccgccuucuugaauuugacagguugcuauucuugcaaugcaggggccagagucugccugucuaucacauccacaggaacuggaacucucucugcccacaauaaggacgggucucugcauauaguucucccaucagagaacgggacaaaagaucagugucagauacuacauuuuacuguaccugaaguagaagaggaguucauguacucuugugauggagaugagcggccucuguuagugaaagggacccugauagcuauugacccauuugaugauagacgggaagcagggggggaaucaacaguugugaauccaaaaucuggaucuuggaauuucuuugacugguuuucuggacucaugaguugguuuggagggccgcuuaaaacuauacuccucauuugccuguauguugcauuaucaauugggcucuucuuccuccuuauauaucuuggaagaacaggccucucuaaaauguggcuugccgcuacuaagaaggccuca

SEQ ID NO: 4655 - RNA, 4020 nt, Artificial Sequence
  derived and/or modified CDS sequence (wt) from SFNV(Toscana)__NC_006320.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacaucuggcacuuguaaagugggaucacuggaaaacagggauugcaaaagagacaucaugucaaauuauguugcagaagugcauuccaacuuacauggccuaggagcuaugaugcacaacuauggugaugacaagaggguugagguccucaaugaugucaucccagaugagcucaauccaggacgccacaacugcagugaccuggaccggaaaccauuuuggacagaguuuauuaauguggcaaagccagcaaacaaaauagcuccuauaucagugaucccaccaccaauugugaagcccauaccaauugcagaaucaacuaucaagaaaaccaucccauuugauaaacuccuaucugaagcagaaaaggaguugaaccaaacaaaaaucagauuggaaaccgaaagaaggucuaaugcggaagaggcugcaagagaaagggccaggaugagagaaauugaagacaagcugagaaagaauugggagcuagaacgggagagaaaagaugcaguggcagacgaccuggcaaaagaaauagcgagaagaagagagauagagagaaaagcucaugaauuagauaagaugcucaagaagaaggagcgugaagaucagguggcaauagaaagggugagugaggauaugagaaaccaugugcguagaccaaauacaaccauagccccugcucccacgaucauuaccacccugcucauggccagugcgguaauggcaggaccuuuggagaacagggaaacaaaccacuuacuaaacaggccagggaauggagcuuauacccuaagugacuuugcugaguccaccugcacgcuagcuuauggcucaaagugcaaauccugggagcaccaauuggaugagcugucuuuucccuucuuccacucuaaccuugacaaguacagcaugcuagaggcugcaacagagacaauaccgauacucaacaagagcucagcugucugcacaauuuccccauccacgcauucaucaaaugcauguggcagggaagcuagccucauaaagaagaaauguggaaacaauaugucugcuuucuucuauguuaaccuagccggccagauaacuguugucaagugugauacaaaccauguuuugucuaacgacugugggaauuguaucucaaaaaccuugagcggucagaagauuuauacuccaguucaggauauguucugucagagaggcuggacggaguccaucccaagcacaagguacucaaaagaccucuguucuauuggcuugcacacugugaaggaaugcaagacugguaccaccaacuuugagagaguagguuucauugucgugaagagucgaaagauguacauagagcagaugaagaugagaucaagacaagaauucagcgaagaccaguucuuaugcuacaaaucagagagcaguucuggcucuucuguaaaauuaaagaaggucaagguugagucaugcaaagguguuacaacaucaucagccucuaagugcucuggggaugaauauuucugcagcagguacccaugugaaacugcaaauguugaagcucauugcauuuuacgaaggcauagugcaguuauagaagugaaugucaauggcguguggguugugccgagaugcauugguuaugaagagguucuuguuagaaggacuucacucaaaauggaagauacaucuaguagagaaugugauaccugcuuaugggaaugcggaaaaaauaaacuaauugucaaaacucauggccccaaaauaguuuaugcaacagcauguagccaugggucuugcaagagugugaugcaaaagccagcgaccuucguguaccuaccguacccaggaaacagcgagauuguuggaggugauauagggguccacaugacagaggaaucaucaccuucaaacauacacaugguggcacacugcccugcgaaggauuccugugagguuagcagcugccuauucugugugcacggacugcuuaauuaccagugccacaccuuguucucugcacuacuaauauccacuacugugauguccauucuuacauugcuacuucuucuugugaagggggcuaaagaucuugucaagaaauuauucuacuggcuaauuacaccccugugcuggcuaucaguguucuguggcuggaugaucaaaagcuggaaaaagaaagugggcucagcuauuucuagaaccaaugacaccauugguuggcgugacaauagacgauaugggcgagacguugagagagcacaguacacaggaggagcuccaggggcuaaauauucauuuuauggagugaugauccuuggccuauuagguaaugugcauaguugcucugagagugucauagccgacuccaaagucaugcaaugcacaacuucgggaaguucuacccucugcaaggcuagugggacugugauuaugaagcuagggccuauaggcucagaguccugccugauuuugaagggucuuaaggacaaugaaaagcaauucaucucaaucaagacaauaucaagugaacucacaugccgagagggagaguccuucuggaccacucuauauacuccugucugucuaaguucgcgaaggugccaccuaaugggagaauguugcuccgaccgcugccucaaauggaaaaccaaugaaacaucugcagaauucacugggaaggcacauggagaaguuaugcaugagaauagaugcuuugagcagagcgguggaauaggcuauggaugcuuuaaugugaacccuucuugucucuacguccauucaauucucaaaucugucuacaagaauggauucaagaucuuuagauguguggcauggaaccacaggauuagacuugaaguuacuacccacucccggaaauucccaaugguuuugauggcuaugagcacacaacccacugacugggguucuauuggguuaauccuagauucagaagggauaacagggacuaacgcguauuccuucaugaagcacgggucaggaagcuuggccauuauagaugacccauauuccccagagccucguaaaggcuuuuuaggagaagugcgauguccaacagaagagacagcuauucgggcgucacccucauguaagauggcuccuaacuugauugaguaccagccugagauggacacugcagagugcacuacaaacaugauagaucccauggccauauucaaucgaggguccuugccacaaguucgggauggaaugacauucacacaaucaauugagaagaacacaguucaagcacugacaacaggggagguuagagcuuccauacgccuuacauuggacgacuaugaugugguguaucacaauagccaguccgacugcucagcuacauuuaagaaucucaccggcuguuauucaugugaugaggguucaagaaugugcuaccaggugaaggcagaaggagaaacuaucuuucacuuugucaaugaggaugaaucuaucaauguuauuaacaaggugagcccagacguaagugacuacugcacuguucuccacuucucaagaccugucaucucuauugaagggagguaugacugcgggcuuagcaaaaguccaaugguaauaaaagguacucuaauugcuacugccccgcaugaugacaggaagcaugaaggagguuccucauugguugucaaccccaaaggcggcacaguugacuucuucgggugggugucuggacuaaccucauggcuaggugggccucugaaaaccuucuugaccauccuuggauuccuagcucugggccuacuuuuaguagugauaaucaucaccauugcucgcacuggggucgaacaggcccuaaaaaagaaaaacaaguaa

SEQ ID NO: 4656 - RNA, 3972 nt, Artificial Sequence
  derived and/or modified CDS sequence (wt) from SFNV__HM566171.1__GP
auguugaauacaaaaucuauaauuuuaauaaccugucuagugcagcagguccaucugaaauacacgauuauuucagaggugacuaagggugcuagggaggugagcugcuauagcucaacaaccagauuagaccagcucuuggaggcuugggagaauaagagugcccuaaugggacuuagaaaaggcaauugcaaacuuggagcuauggagcagguggauuguaaccuugaucucaugucaaacuacgucucuaaugucuaugauaauccacacgguuuaggagcaaugauguacaaugauaagaggauugagguucuaaaugaccagauuccugauucuaugaucccuggaggacacaauuguagucugcuagagagaaagccauucugggcugaucucauaccaucaaaaaaggagaaucccaggccaucucugauuucccuuguuccaacuccaagaagugauuucaaaaggaaauucgaagaagcugaagaagaaaugaagaaaauaaggaaagaauuacaagaugagcgucaggcgcaauuaaguguuauugaagaaggcaggaaaaggaugagggacuuagaggacaaacuuaugaggcaguggaaugaagaaaagcagaagaagggacugcuugaggaaacuuuggagaagaaaaggcaacugaaaaacaaggcucuucuugaugcacauaaucuagacaagcaguugaaggaaaaggacagagaauuuaagacagccauggaagagcaucagaaugagagacauagaaucaacaguaauaugaucagaccuccuaucaccacucccgcagcugugaucuugacuucucuuuuaucugccagugugguucuaggcuucgaauuggaaaauaggaacacuaaucaugcacuaaacagaccugggaauggugguuacucuauuagugauaacaaucugauagaggcuaaaugcaugaucaccuauggcaacaagugucccuccugggaaaugcaguuagauccugugucauaccccuucuucucuuccaauuuugagaaguacagucugcuagagucuauuucagaaaccucaccgauaauagggaaguucucagaagucuguguucucucaaacuuaccuggagcucagaaaacaugugccaaagaagcaagcuuaaucaagaagcaauguucugaugacaugagagccuacuucuacauuaacucuuuagggaaacuugcaauugucacauguccagagaauaauguuuugucacaagacugcaauuucugucuacgaaaagccaaaggagagcaguauguuuacaaacccauucaagauggcuuuugucagaauggagguguuucuucuguuccuagcauuagauauucaaaagauaucugcuccauaggaccaacaaagguuaaaaauugucacaaaggcacuucuagguacgaaaggacagcauucauauccacuggagacaaaaaaguauauuuggaggaaauuaaaauaagaucuaggcaagaguaugagccugaucaguucuuaugcuacaagguaaaggacagcucuucaucgccucuugccuacgagaagguccaaguguccaaauguaaaggcauugaaacaaacagcccuaagaaaugcacaggagaugaauacuucugcagcaaguacccuugugagucaaccagcccugaggcaaacuguuuccucagaaagcacagugcaauacuagaggucaacaucggggggauguggauuaagccaaaauguauugguuaugagauggcccuaguuaagaggguuggucucaggucugaagaugucucaucaaaggagugugccacuugcuuaugggagugcuccagugguuacauaagcaucaccacacaugggccuaagauuucuuaugcaacugcauguagucauggaucuugcaagaguauuguucaaaacccaucaacauccauuagaauuaguuauccaggaaacagugaaauugucgggggugacauagggauccacuuaacugaggacucaucuccuaucaaccuccaucugaagauccacuguucaccuaaggauucuugugaagugagugauugcauuuuuugcguucauggguugcugaauuaucaaugucauuccguggcuucugcucuccuuuuguccacuaucacagcaucucuuauuguguuaaugauuuacaugcuuucuaaaacuaaguuuguaaugaaaaagcucauaccaauuaugcucacuccgcucugcugguguuuuguacugcuagcuugguuaacuaagucuuggaaagggaaaaugaggaaugcaauucagucagcuaacuccacaauuggguggacagaacgugaagaaaggauuguugcggaaagaccaaggagcaggaauaccguaagguauucuuucuaugggguuguuauacuagccauguuagaaucugccuuuggcugcucugaaagccucauugcagagucaaaaguaaugcaaugcaauauugcaaaugggaaaacaagcuguagagccucugggacaauuauuaugaaauuagggccgauaggaucagaagcuugucugauucucaagggacuuagggauagugacaagcaguacauaucugugaaaacugaaucuagugagcugaucugcagagaaggagagucauucuggaccuccuuguauacuccaguuugcuuaagcucaaggaggugucauuuaaugggagaguguacaggagacuugugcuuaaaguggaagucaaacaaaacuucuuuagaguuugcuggcaagacacguagugaugucauaaaugaaaacaaguguuuugagcagaguggugggcuaggauaugggugcuucaaugucaacccuucaugucucuauacucaugcuuauuugaagucaguuuacaggaaugguuuuagaguguucaagugugcuucuuggacucauagaguuaaguuaaccauuaccacgcacucuagaacauucccuaugacccuagcagcaaugagcacucaacccacagacuggggcucaauuggucuaauucucgacucagaggggaucucagggacaaauuccuuuuccuucaugaagcauggucuagggagcuucgcuauaauagaugagcccuauucaauggaacccaggaagggguucauuggagaagucagguguccaacagaagaagcagcuauaaaagccucuacucuguguaagacagcuccccaguuaauagaauaccaaccugaaauggacagugccgaaugcaccacaaauaugauugauccaaugagcguauucaacagaggcucccuuccccagguuagagaaggaaugacuuuuacucagucuauggagaagaauaccguucaggccaugaccacaggggaaguucaugcuagcauuaggauaguucucgacgacuaugagguugaauaucuuucaagucagguugauugugaugcuacauucaaaaauuugacugguugcuauucaugcgaugagggugcaagaguguguaugcagauuauagcacauggggauacuauauuccacuuuagaaauccagaugugaguauaaauauucuacaaaagguuaauacaaacacuuugauuuauugcucuguagugcacuuuucaaagccuguuauaaaagaggaaggaacauaugauuguggagcaggagagaagccaaugauucucaaggggacauugguggcgguuucuccucauaaugacagacuggaacagggagguuccucaauugugauuaauccaaaaggggguggaguugacuuccuuggcuggcuuucuggauuuagcucuugguuugggggaccucuuaaggcuauuuuaauggucauugguuuccuucuccugggccucaucuuguuugugacaauugcgaucggccuuaaguuugcacucagacaaaugauaguuaaaaggaugaaauga

SEQ ID NO: 4657 - RNA, 3873 nt, Artificial Sequence; identical to SEQ ID NO: 4340
  derived and/or modified CDS sequence (wt) from SFNV(Namru)__HM566169.1__GP

SEQ ID NO: 4658 - RNA, 3990 nt, Artificial Sequence
  derived and/or modified CDS sequence (wt) from SFNV/SFNV-like(Poona)__HM566177.1__GP
auguugaacguaaaaucuguaauuuuaauaaccugucuagugcagcaggcccaucugaaauacacaauuauuucagagguggcuaagggugcuagagaggugagcugcuacagcucaacuacaagacuagaccaguuacuagaagccugggagaacaagagugcucuaauagggcucaagaggggcaacugcaaacuuggugcuauggagcagauaaacugcaaccuugaucuuaugucgaacuauguuucuaauguuuaugacaacccacauggccuuggggcuaugauguauaauacagacagugauaagaggauugagguguugaaugaccagauuccugauucuaugaucccuggaggacacaacugcagucuacuugagagaaaaccauuuugggcugaccucauaccaccaaaaaaagaaaaagaauuggauccuaaaccaucuuuaaucucucuuguuccuacuccaagggaugauuuuaagaagaaguuugaggaggcugaggaggaaaugaagaaaauaaggaaggaguuacagaaugaacgucaggcacaguugaguguuauggaagacaguaggaagaaaaugagggacuuagaagauaggcucaugagacaaugggaagaggagaaacaaaagaagggacuacuugaggaaacucuagagaaagaaaggcaacuaaagaauaaggcccuucuugaugcacaugauuuagauaaacaguugaaagagagagauagagaguuuaaaacagcuauggaagaacaucagaacgagaggcgcaggauaaacagcaacaugauuaggccuuaugucacuacuccagcagcuauaauauuaacuucccuacuaucugcaagugugguuguaggcuuugagcuggaaaacaggaacacuaaucauguguugaauagaccuggaaaugguggcuacuccauuagugauaauaaucuaauagaagcuaagugcaugauuaccuaugguaccaaaugccucuccugggagaugcaauuaaacccuguuucuuaccccuucuucucuucuaauuuugagaaauacaguuuauuggaaucuguuucagagacuacaccaauaauagggaaguuuucagaggucugcguucuuucaaauuuaucaggggcucagaaaacaugugcuaaggaggcaagucucaucaagaaacagugcccagaugauaucagagccuacuucuacauuaauuccuuggguaaacucgcaauuguuacauguccugagaauaauguuuuaucucaagacuguaauuucugugugccuaaagcuaaaggagaacgauauauuuacaaaccuauccaggauggcuucugucagaauggaggcguuuccacuguucccaguguucgauauucuaaagacauuuguucuauagggccauuaaagguuaaaaacugucauaaaggaacuucuagguacgaaaggacagccuuuauaucaacaggagacaaaaaaguuuacuuggaggagguuaaaauaagguccaggcaagaguacgagccugaucaauuucugugcuacaaagugaaggauggaucuucaucaccucuugucuaugagaaaguccaaguauccaaguguaagggcauugaaacaaauaguccuaaaaaaugcacaggagaugaguauuuuuguaguaaguauccuugugaaucaaccagcccugaggcgaauuguuaucucaggaagcacagugcaauaauagaggucaacauuggagggaugugggucaaaccgaagugugugggcuaugagauggcucuaguuaagagaguuggucuuagaucugaagaugucucucugaaggagugugccacuuguuugugggagugcucuaguagcuacauaaguauuaccacacaugggccuaagauuucuuaugcaacugccuguagucaugggucuugcaagaguguaguccaaaguccaucaacuuccauuaaaaucagcuauccaggaaauagugaaauuguuggaggagacauuggaauacacuuaacugaagacucauccccuguuaaucuccauuuaaagauucacuguccaccuaaagauucuugugaaguaagugauuguauccuuuguguucauggauuacuaaauuaccagugucauucuguggcuucugcgcuccuucuauccaccauaauagcaucucuaauagcguuaguugucuacaugcuuuccaaaacuagauuugugaugaggaaaauuguaccaauuauguucaucccauucugcugguguuuuguauuguuggccugguuaaccagaucuuggaaaggaaagguaagaaaugcaauucaaucagccaauaauacaauuggauggacugagcgugaagagagagucauagcagagagaccaggaggcaggaauacaauaagguacucauuuuaugggguuguuauacuagcaauauuggaaucugcuuucggaugcucagagagucucauugcagaauccaaaauaaugcaaugcaauauugccaaugggaaaacaagcuguagggcuucugggacaaucaucaugaagcugggaccaauaggaucagaggcuugucuaauccuuaaggggcucagagauagcgacaagcaguacauaucugugaaaacugaaucuagugagcuaaucugcagagaaggagaaucauuuuggacuuccuuauacaccccagucugcuugagcucaaggagaugccacuugaugggggaguguacgggagacuuaugcuugaaguggaaaucuaauaaaacaucuuuagaauuugcugguaagacucauagcgaagucaugaaugagaauaggugcuuugagcaaaguggcgggcuaggauauggaugcuucaacaucaaucccucaugccuuuauacucaugcuuaucugaagucagucuacagaaaugguuucagaguauucaagugugcuucuuggacacauagagucagauugacaauuaccacucacucuagaacauucccaaugaccuuagcagcaaugagcacccagccuacugacuggggcucgauuggccucauucuagacucagaagggauuucaggaacaaauucuuucucuuuuaugaagcauggauuagggagcuuugcuauaauagaugaaccguauucaauggagcccaggaaggguuuuauuggugaaguuagaugcccaacagaggaggcagccauuaaggccucuacccuaugcaagacagcaccacaauugauagaauaccaaccugagauggacaguguugagugcaccacaaacaugauugauccaaugaguaucuucaacagaggcucucuuccacaaguuagggagggaaugacuuuuacucagucaauggagaagaacacuguucaagcuaugacuacaggagagguucaugccagcauaagguuagugcuugaugacuaugaaguagaauaccucucaaaucagguugauugcgaugccacuuucaagaaucugacugguuguuauucaugugaugagggugcuagaguguguaugcagauuaaagcacacggagacacuauauuccacuucaaaaacucugauaugagcaugaacaucuuacagaaggucagcacgaacacucugaucuacugcucugucguacacuucucaaaaccagucauaaaagaggaagggguauaugacuguggagcaggagaaaaaccuaugauucucaaaggaacguuaguggcagugucuccucacaaugauaggcuagagcaaggagguucaucaaucguuaucaacccaaaaggaaguggaguugauuucuugggcuggcuuucaggguuuaguuccugguuuggagggccacuuaaagcuaucuuaacaguaauugguuuccuccuacuaggauuccuucuauucauguuaguaacaauuggccuuagauaugcucuuagucaaguggugaccaaaaagaugaaauaa

SEQ ID NO: 4659 - RNA, 4002 nt, Artificial Sequence
  derived and/or modified CDS sequence (wt) from Arrabida virus(PoSFPhlebV/126/2008)__KP863800.1__GP
auguuuuaugcaaaguuuauacuacuacucuguuucgugcagggggcucucuugaaauauaccauuauuucaaaaguggggucuagcacauacaagaggguuuguuuaagucauacuacugaccuggacacacuacuagacaugaccaguagagaaaugagcaauaucaagcugacuggaggauccugcagcuuaggugauuugacaaagccugauugcucaccugacuucuuuucaaacuauguggccaacauccagaguagcaacaccaaaaucacuggcaaauuccaggacauaauuggagaaagagaaauggagguuaccaaugauguuguuccagauaguuuugguccugggccacaugacugcguuaguuuugauaagaagccauucuggucggaccuuuugccaacaagugucagcaaggaggagccaaagccuaucauuuccacccucucagugcuaccugcagcuccaccuaucaaggacuuuagccacaaaguugucgaggcagaggagauggucaaagaaauugaaggugaauugaugaaagagaaggaaagaaauucugccaaagaagaagaggcucgacaaagaaugagagaacuggaagaugaccucagaaagcagugggccgcagaaagaauggccaagcagaacaugagcucuguacuagaaagggagagacaggaaaagcagagucuugagaggagaaugcacgagguugacaaaaagcuaagagcaucagaagacagggcccagaaauaccaagagagagcugaacaagcugagaagagccauucaaagcugcucucuaggaguggggcugcgacgacaauggcaacaguagucuuuaccuccuugcuagcuucuggguuggcaguugucacugaacuagagaagagggauacaaaccacuuacugaauagaccaggaaaugguguuuauauggcaaacgcagauucauugauucagacagagugcacccugaauuauggacaaaggugcuuggcuugggagcugcagauaacaccuguuagauacccauuuuucacgucaaauguugauaaguauagccuucucgaaucaaucacugaaaccccauccauacuagaaaagaacaaugagucgugucagcuggcaacuacaucaggaucacugaagacuugcgcaaaagaagcuaguaccauaaagaagcauugcacugaugauguccgugcuuucuucuucauaaacucugugggaaaacuuacaauuguccgaugugcagacaaccacauucugucagaggacugcaauuucugcauuagcaaggcaaggaauuccaaucagaauauguucaugccaguacaagaugcauucugucagaggcagggaucugacacugcacccgcaauacguuacucaaaagauaucugcuccauuggugcaauaaagauaaagcaaugucacaaggcaacaucuaaauucgagcggauggguuucauuaguguugggcaaaagaagcuauacauugaagagcucaaauugcgauacagacaagaauaugauccagaucaguucaugugcuauaagauuaagagcagcaguccucuuaaauaugaaaaaguguccuccaagaaauguaaggagguugauacugguggaaaccaaaaaugcaguggggaugagcacuuuugcaacagauaccccugcgacacugccaauccugaagcacacuguuuaacaaggaagcacucagccauagcagaaguaaacaucggagguguuuggaucaggccaaaauguguggguuaugaaauggucuuggugaagagaaguggucucaaaucagaggacuugucaauaagagauugcccuucaugucugugggaauguaaaaaaagcagaaucacaaucaaaacucaugggcccaaaauagucucagcaacugccugcagucacgggucaugcaagaguguaaugcagaaaccauccacauuuguggaaauaccauacccuggaaacagugaaauuaucgguggagacauaggaguccacaugacagagaggggcucuccuucuaacauccaugugagaacacauugcccuccaagggacucaugugauguuucugacuguauguucugugugcaugggaucuugaacuaccaaugucauacucuagccucugcccugaccauagcaacuauaguaucagcuguacuuguugugguguacuuccuacuggcuagaucuaaaagggcagugaaauucaucacuucuuuauugauuguuccuuucaaguggcuaacucuucucucuauauggguugugaagaacuggaaaaggaagaugucaaaacuggccagggcaacuaauaaugcuauagguugggaucaggaugucgagaggggcagaccuagagcugcagcaggacaccagaaucaaguugccagguacacauuuuauggugccacaaucuuaucauugaugaccucaggacuuugcugcaccgagagugugaucgcugaaucuaacaucaugcaaugcacaacuagugacaguacgaccacaugcaaagccaguggcacaaucauccucaggcugggcccuauugggucagaaagcugcuugauucuaaaagggcugagagacagugaaaagcaauucauaucuaucagaacagucuccagugagcuaacauguagagaaggagauuccuucuggacaucuuuguacacuccaauuugccuaagcuccagacgaugccaccucaugggcgaaugcacaggggacaacugcuuaaaguggcaggacaacaaaacaucaucugaauuuacaggaaggacacauagugaagugcugcaugaaaacaaaugcuucgagcaaaguggaggcauuggcuaugguugcuuuaaugucaauccauccugccugaugguccacucuuauuugaagccaaucuauaagaaugcuuuuaaaguuuuccgcuguguugccuggaaccacagagugaaacuugccauaaccacacauaagaagagcuuugaugucacccuaauggccaugagcacucagccuacugacuggggaucaauugggcuaauccuagacucugaaggaaucacaggcacaaauucuuacuccuucaugaaauacggaguagggaguuuugccauuauugaugagccauuuucaauugagccuagaaagggauuuuugggagaaguccgcugccccacagaagaaacugcugugaaagcgucaccaucaugcaaggcugcuccacaaaucauugaauaccauccagaaauggacacaguugagugcauaacgaacaugauggauccaauggccaucuucaacaggggcucacuuccacaggugagagacgguguuacauuugcucagucaauugaaaagaauucuguucaggcucugacuacuggagaaauaaaagcaaguguaagacuuguucuagaugacuaugaaguggaguacaaaguuagugagaaugacugugauucaacuuucaucaacauuacagguugcuauucaugugaugagggugcaagauugugugugagaaucaggacacugggugacucaaucuaccacuucaccgacagugaggacaugaugaaugucauguuuaaggucaauuccucaguaacugaguauuguacuguacugcacuucucuaagccaguugucaacuuugaaggcaaguaugacugugggaagagcagaaagccaaugauaauuaagggcacacuuauugccauggccccacaugaugauagaguucacaguggcggcucuuccauagucguaaauccuaaaagcaagggaguggacuuccuaggcuggcuaucugggcucagcucauggcuugggggaccauugaaaacaguccucacugugcuuggguuccucauuuuaggccugguauucguuauuguuguuaucuuuuuggucaggguugggaucagacaagcauugcugaagaaaaugaaguga

SEQ ID NO: 4660 - RNA, 4005 nt, Artificial Sequence
  derived and/or modified CDS sequence (wt) from Massilia virus(127)__KT906100.1__GP
auguuuuaugcgaaguuuguaauaagccucugcuuagagccaggcuuuucuuugaaauauacaauuauuucaaagucagggucugguacuaucagacaaaucugcuuaagucauucgacggacauugauaaggucuuggagcuuuccaguggggagaugaacacaauuggcauccugggaggccucugcacauuuggugaacuuaagagagaagacuguucuccagauguguucucuaauuauguugcaaauauguaugggacugcucacccuucaagcugcaaauucguggacauaacaggggacaggagcauugaaguucuaaaugaugcuguuccagacagcuucacaccaggagcccacaauugcaguagcuucgaaaagaaaccauucuggacugaccugauuccugcuaagaacagcucaggagccauaccuucugugguuucaguuuuaccuucuguagcugaacaugauuuuaaucucaaagugaaggaggccaaugauaaauuagaagugauucaaagagagcuugcagcagagaaggcacgcucaggaaggcuagaagaugaggcacgcgcuaagaugaaggcuuuagaagaugagcuaaggaauggauggcuagcugaacgggaagccaaagaacuggccaagucagcgcuugaaaaggaacggaucaacaaauuagagguggaaagaaagcugcacgaucugggaaagaaguuacgacaaucagaagacgauguugagaaaaugaggguacaucauaagaaggggaggaaggagucggacgaggagaugaaaauugcaagaacaacugcuccuaguguauccacaacucuggccacuguuguuuucacaucucugcuagccacaggacucgcagcuauugagccaauugaggauagaaauguuaaccacauauugaauaggccaggaucaggaguauacauggcuucaccaacucucacccaaaaugagugcucucuugauuacggaaaagaaugcaaggccugggaauugcaaguuagcccacuacacuacccauucuucaccucuaauguggacaaguauaccuuuuuagaguccaucacucuauugccuccuauucuacuuauuaacaaugaguuuugugaacugaccacuaguucuggcccacuaaaacaaugccagaaagaauccagcuugauaaagaaaugcuguacugaagaugcuagggcuuacuuuuucauugacuuagaagguaaacuaucgauuguucacuguucaaacaaccaggugcucucggaagacuguaacuucugugugacaaagucaggaggggucagccacaagaucuucaugccuauacaagaugcauuuugccaaaagggugggucugaauccauuccuguugucagauacuccaaagacauuugcucaauaggacuguccaaggugaagaguugucacaaaaguacaucuagguaugagagaaugggauuuauuguugcaggcaagaaaaaacuguacauagaggauuugaaaaugagauaucgacaagaauaugaugaggaucaguucuucugcuauaaagugaauaagacaucuccauuggaauauggcaaagaguccccuucaaaauguaagggaguuggcucaaaugagcagaaauguaauggagaugaauacuuuugcaacagguacccuugugaaacuaauaguccagaggcucacugcucucugagaagacaugcugcaguuguugagguuuauguuggaggggcauggauaaagccuaaguguguggguuaugagaagguacuggucaagcguggaggacucaagacugaggaucucucuguuagagaaugcacaagcugucuuugggagugugaaaagaauaaaauugugauaaagacucauggacccaaaauugucucugcuacagccuguggaggucgcucuuggaaaagugugaugcaaaaaccaucaacuuuccuugaucucccauacccuggcaauagugagauuauugguggggacagaggaaaccaucugagcgagcgaggaucuccauacaacauucacagcacuauacauucuccaccagaagacucucgugaugcuucagauuguauauacuguagacauggccuauuaaauuaucagagccauagcguagaaucagcgauccuucugucaacaguaguugcuacuauucuggcacucacugggguggucuuguccagaucaaaaucugccguaagguuucuagcaucugcagucgcugucccauucagaugggugucccuacugguuguuugggugaugaaaaaauggaaggcgagaguugcaaccgcuauuagggccacaaacaaugcuauaggcugggacaacggccuugagcaggccagaguggagaaugcagcaaggagacaacagacagcaggcagguggaggucgcuagaugcgucuaccauuuuauccgucuugagcacaggauuaugcugcacugaaagccugauugcugagucuaguaucaugcaaugcaccacaggagaagguucaacaaccugcaaggcaacaggaacagugguauuaaaacuggggccaauagguucugaguccugcuuaauccuuaaaggccuuagagacaaugagaggcaguuuauuuccauuaagacuauuucgagugagcuaacuuguagagaaggggagucauuuuggacaccguuauacaccccaguaugcuugagcucaagacgaugccauuuaaugggugaauguacaggagacaugugccuuaaauggaaaucuaacaaaacuucuucugaauucacugggaagacacacagugaggucauucaugagaacaaguguuuugaacagaguggaggaauagguuauaugugcuuuaaugugaacccuucuugcuugauggugcacucauaucuuaaacccaucuacaaaaaugcuuuuaagguuuucagaugcauagccuggaaccacagggugcgucuuggcauaacaacgcauaagagaaaguuugaagucacccugauggccaugagcacacagcaggcugacuggggcuccauugguuuaauucuggauucugaagggauaucagggacaaacuccuacucuuuuaugaagcaugggcuagggagcuaugccauaauugacgagccauacucuguggaaccaagaaaaggcuaccugggugaggugagauguccaacugaagagacagccaucaaagcaucaccuucaugcaaaguugccccaggguugguagaguaucagccagagauggacacacuugaauguacaaccaacaugauggacccaauggcaaucuucaacaggggaucauuaccccaggugagagggggguggacuuucucgcaauccauagaaaaaaauucacgacaggcucuaaacacaggggcgauuaaugccagugugagacauguucuagaugaauaugaguuugacuacaaagugaaaacuaacgacugugauucuacauuugugaauauuacagggugcuauuccugcgaugaaggugcaaggcugugugugaaaguaaggacaucaagugaagcaauauaccacuuuacugacucaggcuacaacauaaaugugcuguucaaaguggaaucuggugugcaugaucacugcacuauucuacacuucucaaaaccuguuaucagcauugaagggaaguaugauuguggaaaaaacaagaagcccaugcugaucaaaggaacacuaauagccauggcuccucaugaugacagagugguuagcggaggcucuuccacugucguuaaucccaaaggccaaggaguggauuucuugggcuggcuaucucgguuaaguuccugguucgguggagguccucugaagacauuuuuaaugguaacgggauuccuuaugacuggggugaucggugguauaguuacuaucauccugauacgaauagugcuacaacaggcacuagccaagaaaguuaaguaa

SEQ ID NO: 4661 - RNA, 4005 nt, Artificial Sequence
  derived and/or modified CDS sequence (wt) from Massilia virus(130)__KT906101.1__GP
auguuuuaugcgaaguuuguaauaagccucugcuuagagccaggcuuuucuuugaaauauacaauuauuucaaagucagggucugguacuaucagacaaaucugcuuaagucauucuaccgauauugacaagguucuagagcucucuaggggggagauggacacaaucagcauccuaggaggccucugcacauuuggcgaacugaagagagaagacuguucuccugauguguucucuaauuauguugccaacauguauggaaccacucaccccucaagcugcaaauuuguggacauaauaggagacaggagcauugaaguucuaaaugaugcuguuccagacagcuucacaccaggagcccacaauugcaguagcuucgaaaagaaaccauucuggacugaccugauuccugcuaagaacagcucaggagccauaccuucugugguuucaguuuuaccuucuguagcugaacaugauuuuaaucucaaagugaaggaggccaaugagaaauuagaagugauucaaagagagcuugcagcagagaaggcacgcucaggaaggcuagaagaugaggcacgcgcuaagaugaaggcuuuagaagaugagcuaaggaauggauggcuagcugaacgggaagccaaagaacuggccaagucagcgcuugaaaaggaacggaucaacaaauuagagguggaaagaaagcugcacgaucugggaaagaaguuacgacaaucagaagacgauguugagaaaaugaggguacaucauaagaagaggaggaaggagucggacgaggagaugaaaauugcaaagacaacugcuccuaguguauccacaacucuggccacuguuguuuucacaucucugcuagccacaggacucgcagcuauugagccaauugaggauagaaacguuaaccacauauugaauaggccaggaucaggaguauacauggcuucaccaacucucacccaaaaugagugcucucuugauuacggaaaagaaugcaaggccugggaauugcaaguuagcccauuacacuauccauuuuucaccucuaauguggacaaguacagcauucuagaguccauaacucaaucgucgcccauacuacuuaagaacaacaacucuugugagcuaacaaccagcccuggcacacaaaagcaaugccaaaaggaauccagcacaauaaagaaauacuguacugaugacgcuagggcuuacuuuuucauugacuuagaagguaaacuaucgauuguucacuguacaaauaacuacauacuuucagaagacugcaacuucugugugaguaaguugggggaggucggccacaaaaucuucaugcccauacaagaugcauuuugccaaaagggagggucugaauccauuccuauugucagauacuccaaagauauuugcucaauaggacuguucaagauaaagaauugucauaagaguacaucuagguaugagagaaugggauucauuguugcaggcaagaagaaacuguacauagaggagcugaaaaugagguaucgacaagaguaugaugaggaucaguucuucugcuacaaagugaagaagacaucuccauuggaauaugccaaagugucuccaucaaaguguaagggaguugguucaaaugagcagaaguguaauggagaugaauacuuuugcaacagauauccuugugaaacuaauaguccagaggcucauugcucucugagaagacaugcugcaguaguugagguuuauguuggaggggcauggauaaagccuaaguguguagguuaugagaagguacuggucaaacgugggggacucaagacugaggaccucucuguuagagaaugcacaagcugccucugggagugugagaagaauaaaauugugauaaagacucauggacccaaaauugucucugcuacagccugcggucauggcucuuguaaaagugugaugcaaaaaccaucaacuuuccuugaucucccauacccuggcaauagugagauuauugguggggacagaggaaaccaucugagcgagcgaggaucuccauacaacauucacagcacuauacauuguccaccagaagacucucgugaugcuucagauuguauuuacuguagacauggccuauuaaauuaccagagccauagcguagcaucagcgauccuucugucaacaguaguugcuacuauucuggcacucacuggugugguuuugucuagaucaaaaucugccguaagguuucuagcaucugcagucgcugucccauucagaugggugucccuacugguuguuugggugaugaagaaauggaaggcaagaguuacaacugccauuagggccacaaacaaugcuauaggcugggacaauggucuugagcaggucagaguggagaaugcagcaaggagacaacagccagcagucagguggaggucgcuagaugcgucuaccauucuaucuaucuugggcacaggauuaugcuguacugagaguuugauugcugagucuagcauaaugcaaugcaccacagaggaagguucaacaaccugcaaagcaacaggaacaguggugcugaaguuagggccaauagguucugaguccugcuuaauccuuaagggccuuagagacaaugagaagcaauuuauuuccauuaagacaaucucgagugagcuaacuuguagagaaggggagucauuuuggacaucguuauacaccccaguaugcuugagcucaagacgaugccauuuaaugggugaaugcacaggagacauaugccuuaaauggaaaucuaacaaaacuucuucugaguuuacugggaagacacacagugaagucauccaugagaacaaguguuucgagcagaguggaggaauagguuauaugugcuucaaugugaacccuucuugcuugauggugcauucauaucucaaacccauuuauaaaaaugccuuuaagguuuuuagauguauagccuggaaucauagagugcgccuuggcauaacuacacauaagagaaaguuugagaucacucuaauggccaugagcacacagcagacagauuggggcuccaucgguuuaauucuagacucagaagggguagcggggacaaaugcuuacucauucaugaagcaugggcuaggaaguuuugcuauaauagaugaaccauacucuguggaaccaaggaagggauauuugggugaagugaaaggcccuagagaagaaacugcuaucaaagcaucacccucaugucagguugccccagggcuaguggaauaucagccagugauggacacaguugaauguacaaccaacaugauggacccauuggcaaucuucaacaggggaucauuaccccaggugagagggggguggacuuucucgcaauccauagaaaaaaauucacuacaggcucuaaacacaggggcgauucaugccagugugagacauguucuagaugaauaugaguuugaauacaaagugaaaaguaacgacugugauucuacauuugugaauauuacagggugcuauucuugcgaugaaggugcaaggcugugugugaaaguaagaacaucaagugaagcaauauaucacuucacugacucaggcuacaacauaaauguauuguucaaaguggauucuggugugcaugaucacugcaccauucuacacuucucgaaaccuguuaucagcauugaagggaaguaugauugugggaaaaacaagaagcccaugcuaaucaagggaacacuaauagccauggcuccucaugaugacagagugguuaguggagguucuucuacugucguuaaucccaaaggccaaggaguggauuucuugggcuggcuaucuggguuaaguuccugguucgguggaggcccucugaagacauuuuuaaugguaacgggauuccuuaugacuggggugaucagugguauaguuacuaucauccugauacgaauaguacuacaacaggcacuagccaagaaaguuaaguag

SEQ ID NO: 4662 - RNA, 3999 nt, Artificial Sequence
  derived and/or modified CDS sequence (wt) from Massilia virus(W)__EU725772.1__GP
auguuuuaugcaaaguuuguaauaauccucugcuuagugcaaggcuuuucuuugaaauacacgauuauuucaaagucagggucugguacuaucaggcagaucuguuuaagucauuccacugacauugauaaaguucuagaacucucuaguggggagauggauacaauaaauauccaaggaggucucugcacauucggugaauugaagagggaggacuguucuccggauguguucuccaauuacauugccaacauguacgggacuacucacccuucaagcugcagauuccuagauauaaucggggauaggaguauugaaguaaugaaugacgccaguccagacagcuucacgcccggagcccacaauugcaguagcuuugagaaggcaccauucuggucagauuugauuccugcaaagaacggcucuggcccuucaccaucuguugucucaguucucccuucugcaacagaaucugacuuuagucucaaaguaaaaaaggccaaugagagacuugaagugauucagagagaacuugcugcagaaaaagcacgaucuggaaggcuagaggaugaagcucguacaaagaugagggcccuggaggaugagcuaagaaauggauggcuagcugaacgggaggccaaagaguuagccaagucagaucuugagaaagaacgggucaacaaauuagagguggagaggaaacugcaugaucugaauaaaaaauuacggcagucagaagaugaggcugagaggcugagagaguaccauaacaaaagaaggaaggagucggaugaaaagaugaaaaugacuaagacaguugcuccuaauguguccacaacucuagcgacugugguacucacaucucugcuggccacagggcuugcugcaauugaaccaauugaagacagaaacacuaaccacauacuaaacagaccaggcacaggagucuacauggcuucaccaaccuuaacugaaaaugacuguucucuugauuaugggaaagagugcaaggccugggaacuacaagucagcccacuacauuaccccuucuucacuuccaauguggacaaguacagucuccuagaguccauaacucaagcaucgcccauacugaucaaaaacaacaacucuugugagcuaacaacuagcccuggcucacagaagcaaugccagaaagaauccagcacaauaaagaaguauugcacugaugaugcuagagcuuauuucuuuguugacuuagaaggcaaccucucaauuguacacugcucaaacaacaacauacucucugaggauugcaacuuuugcauaaguaagucaggagucaccggccagaaaaucuuuaugccuauacaagaugcauucugucaaagaggaggaucugaaucacuuccagugauuagauauuccaaggacaucugcuccauaggacuauucaaaaucaagaguugccauaagagcacguccagguaugaaaggaugggguucauuguugugggucggaaaaagcuauaccuggaagaauugaagaugagguaucgacaagaguaugaugaggaccaauucuacugcuacaaggccaagacaacaucucaauugcaguaucagaaggugucaccaucaaaauguaagggaguuggcucaaaagaucagaaauguaauggagaugaauacuuuugcaacagauucccaugugaaaccaauaacccagaugcucacuguucuuugagaagacaugcugcaguuguugaggucaauguuggaggggcauggguaaaacccaaauguguaggcuaugaaaaaguauugguuaagcgugggggacuuaaaacugaagaucucucugucagggaaugcaccagcugccucugggaaugugagaagaacaagauuguuauaaagacccaugggcccaagauuguuucugcuacagccugcagucaugguucuuguaaaagugugaugcagaaaccaucaacuuuccuugaccucccguauccuggcaauagugaaauuauaggcggagacauaggaauccauaugagcgagcggggaucaccauccaacauucacaucacuauacauuguccuccaaaagacucuugugauguuucagauuguauuuucuguagacauggcauauuaaauuaucagugccauagcguagcaucagcgauccuucugucaacaguaguugcuacuauucuggcacucacuggugugauuauaucuaggucuaaauuugcugugagauucuuggcuucugcaguagccaucccguucagguggguguccuuauuagucguauggguaaugaagaaauggaagucaagaauugcaacagccauuagggcuacaaacaaugcuauugguugggauaauggccuugagcaggucagaguggaaaaugcagccagaaggccucaaccagcagucagguaugcauucuaugcaaccaccauccuuucuauuuuggguuccgggcugugcuguacugagaguuugauugcugaaucuagcauaaugcaaugcaccacagaggauagcucaacaaccugcaaagcaacaggaacagugguguugaaguuagggccgauagguucugagucauguuugauucucaaaggucucagagacaaugagaagcaauuuaucuccaucaagacuaucucaagugaacuaaccuguagagagggagagucauuuuggaccucauuauacaccccggugugccuaaguucucgacgaugccaucugaugggugagugcacuggggauaucugccuuaaguggaaguccaacaagacaucuucugaauuuacuggaaaagcacacagugaggucauccaugaaaauaaaugcuuugagcagaguggaggaauagguuauggaugcuucaauguuaaccccucuugccugaugguucacucauaucucaagcccaucuacaaaaaugcuuucagggucuucagauguauagcuuggaaucauagagugcgccuugggguaacuacacauaagaggaaguuugagaucacuuuaauggcuaugagcacacagcaaacagacugggguucuauuggccugauucuagauucugaagggauagaagggacaaaugcuuacucauucaugaagcauggauuagggaguuuugccauaguggaugaaccauauucuguggagccaagaaaaggcuauuugggugaagugagaugcccaacagaagaaacugccauuaaggcuucaccuucaugcaaagucgccccagggcucauagaguaucagccagaaauggacacggucgagugcacaacaaacaugauggaucccauggcaaucuucaauagaggaucguugccacaagucagagaaggaaagacuuucacacaauccauagagaaaaauucaguucaggcucuaaccacaggggagauucaugccagugugagacuuguucuagaugaguaugagauugaauacaaagugacaaguaaugauugugauuccacauuugugaauauaacagggugcuacuccugugaugaaggcgcaaggcuaugugugaaaguuaagucaucaagugaggcaauauaccauuuuacugacucaagcuucagugugaauguccuguucaaggugacuccuaguguacaugacuacugcaccauucugcauuuuucaagaccuguuauuaguauugaggggaaguacgauuguggcaagaacaagaagccuaugcuaaucaagggaacccugauagcuauggcuccucaugaugacagaguaaucaaugggggcucaucuacuguugucaacccuaaaggacauggaguggacuucuugggcuggcuaucaggauuaaguucuugguuuggaggcccucugaagacuuuuuuaaugguaaugggauuccuuaugauuggugugaucauuguuauagucacuaucauccugauucgaauaggacuacaacaggcucuagccaagaaauuuaaguag

SEQ ID NO: 4663 - RNA, 3996 nt, Artificial Sequence
  derived and/or modified CDS sequence (wt) from Punique virus(PI-B4-2008)__JF920134.1__GP
auguuuuaugcaaaguuuguaauaauccucugcuuagugcagggcuuuucuuugaaauauacaaucauuucaaaguuagggucuggcacuacaagacaaguuugcuuaagccacucaacugacuuggauaagguucuugaaauuuccaauauggagauggaugccaucaacuugcugggugguuucuguacacuuggagaauuaaggagggaagauugcuccccuaacguguucucaaacuauguugucaauguacacgggacaauacauucauccaauugcaaguuuguggacauaguuggagacaggaguauugaaguccuuaaugaugcuacaccagauagcuuuacuccuggagcccacaacuguagcaguuuugaaaaaccaccuuucuggacugaccugguuccaaaaaagaacgauacagacccuucuccuucucuucucucugugcucccugcugcugccgagcuugacuuuaaucuaaagcugaaagaggccaaugacaagguggaagcuauucagagggaguuaguugcugagaaggcaaggucugggagaauagaagaugaggcucgcacaaaaaugagggaauuggaagaugagcuaagaagaggcuggauugcugagcgggaagcaaaggagcuggcucauaagaaucuggaggaagagaggguaaguaagcuugagauagaaaggaggaugcaugaucuugacaagaaauuaaggcaguccgagaaugacgcugaucgacugagagagcaguacaacaagaaaagaaagucagaagaagaagugaaaacuccaaaagcaucgacacuuaaugcgacaacuacacuggcuacagugguccucacuucuuuguuggcuacugggcuugcugcuauugaacagauugaagagagaaacacaaaccauauuuugaacagaccagggacaggaguguacauggccucaccgacacuuacucagacagaauguucacuugguuauggcaaggaguguaaaucuugggaacugcaagucaguccauuacauuacccuuucuucacuucuaauguggacaaguacagcauuuuagaaucuaucacucaggagccaacucuacugaucaaaaacaacaauucuugugaauugacaacaaguccuggaucucagaaacagugccaaaaggaaucuaguaccauaaagaaguauuguacugaugaugcuagagccuacuucuuuauugaucuaggaggaaaucuaucaauuguucacugcucaaauaacuucguucuuucagaggauugcaauuucugcaucagcaagucuggagggguuggccagaaaaucuucaugccaauacaagaugcauucugucagagagggggaucagagucaccuccaguagucagauacucuaaagacuugugcucuauaggacucuucaagauuaaaagcugccauaaaagcacaucaagguaugagagaauggguuucauaguggcagggcagaagaagcuguacuuagaagaauuaaagaugagguacagacaagaguaugaugaggaccaguucuuuuguuacaagguaaagucaaacucuccacuucaguaugaaaaggugucaccauccaaaugcaaagggguuggaucacaagaucagaagugcaauggagaugaguacuucugcaauagguauccuugugauacuaauaauccagaugcacauugcuccuuaagaagacaugcugcgguugucgagguuaaugucggugguguuuggauuaagccaaaguguguuggcuaugaaaaggucuuagucaaaagaggggguuugaagacugaagaccuaucagucagagaauguacuagcuguuuaugggaaugugagagaaacaaaguuguuguaaagacucauggccccaagauugucucugccacugcuuguagucauggaucuugcaagagugucaugcagaaaccaucaacauuccuagagaucccuuauccuggaaauagugaaauuauagguggagauauugggauucauaugagugagcgaggcucaccuucuaacauucauguuguuguucauugcaagccuaaggauucuugugauaucucagauugcauuuucugcaagcauggaauacugaauuaccaaugccauaguguagccucagcaguccuccucucaacgaugauugcugccugucuagcucuuguuggagugauaguauccagaucaaagcaugcaguuaaauuccuagcaucuguaguggcaauaccauucaaaugggugucucuacuaacugucuggguugugaagaauuggaagcucaggauaacaagagucauaagagccacaaaugaugcaauaggcugggaaaacaaucuugaacaaguuagaguggaaaaugcugcaagaagaccucaacccgcagucagauaugccuuuuauggaacaacuauccucucaauucuaaguacuggccuguguuguucagaaagcuugauagcugaaucaagcauaaugcagugcaccaccgaggauagcucaacuguaugcaaagcuacuggaaccgugguccugaaauugggaccaauuggcucugaaucaugccugauccugaaaggucuuagagacaaugagaagcaguucauauccauaaagacuauuucuagugaguugacuugcagagaaggagagucauucuggaccucauuguacaccccaguaugucuaagcucucggaggugucacuuaaugggugagugcacuggagauauaugccucaaguggaaaacuaauaaaacaucugcugaauuuacugggaagacucauagugaggucauucaugagaacaagugcuuugaacagaguggaggaauggguuauggauguuuuaaugucaacccaucaugcuugaugguucacucauaucuuaagccgaucuacaaaaaugcauucaaagucuuuagguguguagcuuggaaucauaggguccgucuuggcauaacaacacacaaaaggaauuuugaaaucacucugauggcaaugaguacacagcagacagacugggguucaauagguuugauucuagacucugagggaaucacugguacaaauuccuauuccuuuaugaaacauggauuggggagcuuugcuauaauagaugaaccuuaugugacugagccucgaaaaggcuauuugggcgaaguuagauguccuacagaagagacugcagugaaagcuucuccaucaugcaaagucgcgccuggguugauagaguaccagccagagauggaugugguggaaugcacgacaaacaugauggauccuauggcgaucuucaacagggguucuuugccucaagucagagauggaaagacauucacucaguccauagaaaagagcucaguccaagcguuaacaacaggggaaauucaugcuagugugaggcuuguucuugaugaauaugaaguugaguacaaaguggucaauaaugauugugauucuaccuuugugaacaucacagggugcuauucuugugacgagggugccagacucuguguaaagguaaaagcuucuagugauguaauauaccauuucacugacucagacaacaguaugaauguccucuuuaagguuucuuccaacauccaggauuauuguauagucuuacacuuuucaaagccuguugucaauguugaaggcaaguaugauuguggcaggagcaagaagccuaugcugauuaagggcacucuaaucgccauggcaccucaugaugacagaguaacaaacggggguucaucaauuauuauaaaucccaaaggagguggaguugauuucuuaggguggcuaucaggauugaguucuugguuuggugguccuuuaaaaacuuucuuaauaauugcaggguuccucauuguagguauaauaauagucauaaucaucauaauucuggcacggcuugggauucagcaggcauuggcaaagaaauuaaaauaa

SEQ ID NO: 4664 - RNA, 4020 nt, Artificial Sequence
  derived and/or modified CDS sequence (wt) from TOSV(9028)__KU904264.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucugaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagcuccagccaccugcagaaccauccuccaagaaacauguuccguuugauguacuuuugucagaagcugagaaggagcuaaaccagacaaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauaaaaugcuuaagaagaaggagcgcgaaagccugauugcaaaagagaaagcagaugaggacaugagaagccaugugcauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugauuaagugugaaacaaaccacguccuuucuagugauuguggaaauugcaucuccaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcucagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaacucacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucauauuagaugauuaugaugugguguaucaaaauagccagucugacugcucagccacauucaagaaccucacugguuguuacucaugugaugaaggauccagacuaugcuaucaagugaaggcagaaggcgagacuauuuuucacuuuaucaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4665 - RNA, 4020 nt, Artificial Sequence
  derived and/or modified CDS sequence (wt) from TOSV(A189)__KP694241.1__GP
auguuuauugcaaaguuguuauuaauuuccuguuuagugcagcaggccuaucugaaauacacuauuauuucagaaauagggaacggcacuagaacuucuucuuguuauagcucaagaaccagcuuggggagccuucuggaagcuugggacaacauaacugagucuauuggucugacgucuggcacuuguaaagugggaucacuggagaacagggauugcaaaagagacaucaugucaaauuauguugcagaagugcauuccaacuuacauggccugggagcuaugaugcacaacuauggugaugacaagaggguugagguccucaaugaugucaucccagaugagcucaauccagggcgccacaacugcagugaccuagaccggaagccauuuuggacagaguuuauuaauguggcgaggccaacgaacaaaauggcuccuaugucagugaucccaccaccaauuguaaagcccauaccaguugcagaaccaaccauugagaaaaccaucccauuugauaaacuccuaucugaagcagaaaaggaguugaaccaaacaaaaaucagauuggaagccgaaagaaggucuaaugcggaagaggcugcaaaagaaagggccaggaugagagaaauagaagacaagcugagaaaggauugggaguuggaacgggagagaaaagaugcaguggcagacgaccuggcaaaagaaauagcgagaagaagagagauagagagaaaagcucacgaauuagauaagaugcucaagaagaaggagcgugaagaucugguggcaagagaaagggugagugaggauaugagaaaccaugugcguagaccaaauacaaccauagccccugcucccacaaucauuaccacccugcucauggccagugcaguaauggcaggaccuuuggagaacagggaaacaaaccacuuacuaaacaggccagggaauggagcuuacacccuaagugacuuugcugaguccaccugcacgcuagcuuauggcucagagugcaaauccugggagcaccaauuagaugagcugucuuuucccuucuuccacucuaaccuugacaaguacagcaugcuagaggcugcaacagagacaguaccgauacucaacaagagcucagcugucugcacaauuuaccauccacgcauucaucgaauggcaugugguagggaagccagccucauaaagaagaaauguggaagcaauaugucggcuuucuucuauguuaaccuagccggucagauaacuguugucaagugugauacaaaccacgucuugucuaacgacugugggaauuguaucucaaaaaccuugagcggccagaagauuuauaccccaguucaggauauguucugucagaaaggcuggacagaguccaucccaaacacaagguacucuaaagaccucuguucuauuggcuugcacacugugaaggaaugcaaaacugguaccaccaacuuugagagagugggcuucauuguugugaagggucgaaagauguacauugagcagaugaagaugagaucgaggcaagaauucagcgaagaccaguucuuaugcuacaaaucagagagcaguucuggcucuucuguaaagcuaaagaaggucaagguugagucaugcaaggguguuacaacaucaucagccucuaagugcucuggggaugaauauuucugcagcagguacccaugugaaacugcaaauguugaagcccauugcauucuacggaggcauagugcaguuauagaagugaaugucaauggcguauggguugugccgagaugcauugguuaugaggagguucuuguuagaaggacuucacucaaaguggaagauacauccaguagagaaugugauaccugcuuaugggaaugcgggaaaaauaaacuaauugucaagacucaugguccuaaaauaguuuaugcaacagcauguagccaugggucuugcaaaagugugaugcaaaagccagcgaccuuuguauaccugccguacccaggaaacagcgagauuguuggaggugauauagggguccacaugacagaggaaucaucaccuucaaacauacacaugguggcacacugcccugcgaaggauucaugugagguuagcagcugccuauucugugugcacggacugcuuaauuaccagugccacaccuuguucucugcacuacuaauauccaccacugugauguccauucuuacacugcuacuucuucuuaugaggggagcuaaagaucuugucaagagauuauucuacuggcuaaucacaccccugugcuggcuaucaguguucuguagcuggaugaucaaaagcuggaaaaagagagugggcucagcuauuucuagaaccaaugacaccauugguuggcgugacaauagacgauaugggcaagacguugagagagcacaguacacaggaggagcuccgggggcuaaauacucauuuuauggagugaugauccuuggccuauuagguaaugugcauaguugcucugagagugucuuagccgacuccaaaaucaugcaaugcacaacuucaggaaguucuacccucugcaaggcuagugggacugugauuaugaaguuagggccuauaggcucagaguccugccugauuuugaagggucuuaaggacagugaaaagcaauucaucucaaucaagaccauaucaagugaacucacaugccgagagggagaguccuucuggacuacucuauauacuccugucugucuaagcucgcgaaggugccaccugaugggagaaugugucucugaccgcugccucaaauggaaaaccaaugaaacaucugcagaauucacugggaaggcacauggagaaguuaugcaugagaauaggugcuuugagcagagcgguggaauaggcuauggaugcuuuaaugugaacccuucuugucucuacguccauucauaucucaaaucugucuacaagaauggauuuaagaucuuuagauguguagcauggaaccauaggauuagacuugaaguuacuacccacucccggaaauucccaaugguauugauggcuaugagcacucaaccaacugacugggguucuauuggguuaauccuagauucagaagggauaacagggacuaacgcguauuccuuuaugaagcacgggucaggaagcuuugccaucauagaugacccauauuccccagagccucguaaaggcuuuuuaggagaagugcgauguccaacagaagagacagcuauucgggcgucacccucauguaagauggccccuaacuugaucgaguaccagccugagauggacacugcagagugcacuacaaacaugauagaucccauggccauauucaaucgaggguccuugccacaaguccgggauggaaugacauucacccaaucaauugagaagaacacaguucaagcacugacaacaggagagguuagagcuucuauacgccucacauuggacgacuaugaugugguguaucaaaauagucaguccgacugcucagcuacauuuaagaaucucacuggcuguuauucaugugaugaggguuccagaaugugcuaccaggugaaggcagaaggagaaacuaucuuucacuuugucaaugaggaugaauccaucaaugucauuaacaaggugagcccagacgugagugacuacugcacuguucuccacuucucaagaccugucaucuccauugaagggagauaugacugcgggcuuagcaaaagaccaauggugauaaaagguacucuaauugcuacugccccgcaugaugacaggaagcaugaaggaggcuccucauugguugucaaccccaaaggcggcacaguugacuucuucggaugggugucuggacugaccucauggcuagguggaccucuuaaaaccuucuugaccauccuuggauuccuagcucuaggccuacuuuuaguagugauaaucauuaucauugcucgcacuggggugcaacaggcccugaaaaagaaaaacaaguga

SEQ ID NO: 4666 - RNA, 4020 nt, Artificial Sequence
  derived and/or modified CDS sequence (wt) from TOSV(AR)__EF656362.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccaucgagugaaauagucccaaugucagugauuccaccaccaguugugaagcuccagccaccugcagaaccauccuccaagaaacauguuccguuugauguacuuuugucagaagcugagaaggagcuaaaccagacgaagauuagacuggaagaugagagaaaguccaaugcagaagagacagcaaaggagagggcuaggaugaaggagauugaggaugaauugagaagggagugggagcuggaacggaagaggaaggaugcaauggcagacgauuuagcaaaagaaacagcaagaaggagggagauagaaaggaaggcccaugagcuugauagaaugcuuaaaaagaaggagcgcgaaagccugauugcaaaagagaaagcagaugaggacaugagaagccaugugcauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugguuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuaguuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcaacagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugacuccugcuuaugggaaugugggaaggauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcuaaggauucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguucuacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagggcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauucacagggaaagcacauggugacguuaugcacgagaacagaugcuuugagcaaaguggaggaauaggcuacggauguuuuaacguaaacccuucuugucucuauguccacuccuaucucaagucuguuuacaggaacggguucaaaguuuucagguguguggcauggauucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauuuaagaaccuuacugguuguuacucaugugaugaaggauccagacuaugcuaucaagugaaggcagaaggcgagacuguuuuucacuuuaucaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugggugucuggauugaccucauggcucggagguccucucaaaacauuucugacuauucuuggauuccuagcugugggcuuacuguuaguggugauaauuaucaucaucauucggacuggaaugcaacaagcuuugaagaagaagauaaaauaa

SEQ ID NO: 4667 - RNA, 4020 nt, Artificial Sequence
  derived and/or modified CDS sequence (wt) from TOSV(EsPhGR40)__FJ153283.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucgauuggccuaacuucuggcacuugcaaaguggggucacuagagaacagggacugugggaaagauauaaugucuaacuacguugcugaggugcacucuaaccugcacgggcugggagcuaugaugcacaauuacggcgaugacaaaaggguugagauccucaaugaugucaucccagaugagcucaauccuggacaccacaacuguagugaccuugaccgaaagccauuuuggacugaguuuaucaacguggcaaagccauugagugaaauagccccaaugucagugaucccaccaccaguugugaagcuccagccaccugcagaaccauccucuaagaaacauguuccguuugauguacuucugucagaggcugagaaggagcugaaucagacgaagauuagacuggaagacgagaggaagucuaaugcagaagagacagcaagagagagggcuaggaugagggauauugaggaagaauugagaaaggagugggaacuggagcggaagaggaaggacgcaauggcagaugauuuggcgaaagaaacagcaaaaaggagagagauagagaggaaggcccaugagcuugauagaaugcuuaaaaagaaggagcgcgagagccugauugcaaaagaaaaggaagaugagaacaugagaagccgugugcauaaaccaagcacaacuagagccccagcgccuacaaucaucaccacucuacucauggcaagcacagcccuagcgggacccuuggagaacagggagacaaaucauuugcucaacaggccagggaacggagcuuacacucuaagcgacuuugcugagucaaccugcacauuggccuauggaucagaaugcaaaucuugggagcaccuucugaaugaggagcuguuucccuucuuccacucaaaucuugacaaguacagcauguuggaagcugcaacagaaacagugccuauacuuaauaagagcucugcuguuugcacuauuucuccuucuacacauucaucaaaugccuguggaagagaggcuagugucaucaggaagaaauguuauaguaacaugucagcacucuucuacauuaaccuggcaggccaaaucacuguggucaagugugaaacaaaccauguucuuucuagugacuguggaaauugcaucucaaagagcuugaguggccaaaagguauauacuccagugcaagauguguucugucagaagggcuggacagagucuaucccaagcacaagauauucaaaagauaucuguucuauuggucugcacaccgugaaagaaugcaagauaggaaccacuagcuuugagaggguggguuucauagucgugaaaggccgcaagauguacauugagcagaugaaaaugagaucgaggcaggaauacagugaggaccaauuuuugugcuauaaaucagaaaguggcucugguucaucugucaagcuaaagaaguucaagguugagucaugcaagggugucacuacaucaucagccucuaagugcucuggcgaugaguacuucugcagcagguauccaugugagacagccaacguugaagcccacugcauucuaaggaggcauagcgcaauaguggaagugaaugucaacggaguguggguugugccuagguguauuggcuaugaggagguucuggucaaaaggacaucucucaagguugaagauacgacagaaagggaaugugauuccuguuugugggagugugggaagaauaaacugauugucaagacucauggucccaaaguaguuuacgcaacagcauguagccauggauccuguaaaaguguaaugcagaagccaacaaccuucguguaccuaccauacccuggaaauagugagauuguuggaggugacauagggauucacaugacagaagagucaucacccucgaauauacacuuaguggcacacugccccgcaagggacucaugugaugucagugacugucuauucuguguucacggacuccucaauuaucagugucacaccuuguuuucagcauugcucauaucaacuacugugaugucaauucucacauugcugcucuugcuugugaaaggggcaaaggaucuuguuaagaaguuguuuuacuggcuaaucacacccuuaugcuggcuaucagucuuuugcugcugggugguuaaaagcuggaaaaggagaguaggcuccgcaauuucuaggacaaacgacacuauugguuggcgugagaacaggcgguaugcucaagauauugagagagcacaguacacgggaggagcuccaggggcuaaauauucauuuuaugggguuaugauuuuaggauuacugaguagugcccagaguugcucugagagugugauagcagacuccaagaucaugcagugcacaaccucagggaguuccacccuuugcaaggcaagugggacaguaaucaugagauugggacccauaggcucagagucuugcuuaauucugaaagggcuuaaggacagugaaaagcaguucauaucuauaaagaccauaucaagcgagcucacaugccgagaaggagaaucuuucuggaccacccuauacacacccaucugcuuaagcucaagaagaugucacuugaugggagaaugugucucugaucguugccucaaguggaagaccaaugaaacaucugcagaauucacagggaaagcacauggugacguuaugcacgagaacaaaugcuuugagcaaaguggaggaauaggcuacggauguuuuaacguaaaccccucuugucucuauguccacucuuaucucaagucuguuuacaggaacggguucaaaaucuucagguguguggcauggaaucauaggauuagacuagaggugacaacucagucccgaaaguucccuaugguauugauggccaugagcacacagcccacugacuggggauccauugguuugauucuugacucagaggggauaacaggaacaaacucuuauuccuuuaugaagcauggcucaggaaguuuugcuauaauagaugacccauauuccccagaaccucgaaaaggguucuugggagaagugcgguguccaacagaagagacagccaugcgagcaucaccuucuugcaagauggccccaaacuugauugaguaucagccugagauggacacagcagagugcacuacaaauaugauagacccuauggcuauauucaaucgaggaucucugccacagguucgggaugggaugacauucacacaaucaauugaaaagaacacuguucaggcauugacaacaggggaaguuaaggcauccauccgccucacauuagaugauuaugaugugguguaucaaaacagccagucugacugcucagcaacauucaagaaccucacuggcuguuauucaugugaugagggauccagacuaugcuaucaaguaaaggcagagggcgagacuguuuuucacuucaucaaugaagaagaguccaucaauguuaucaacaaggugagcccagacgugagcgacuacugcaccguucuccacuucucaaggccuauuauuucuauugaggggacauaugacugcgggcuaaguaagagaccaauggugauaaaagguacucugauugccacugcuccacaugaugauagaaagcaugaaggagguucuucucuuguagucaaccccaaaggugguucaguugacuucuuuggaugguugucuggguugaccucauggcucggugggccucugaaaaccuuucugacuauucuuggguuccuagccgugggcuuacuguugguggugauaaucaucauuaucauucgaacuggaaugcagcaagcuuugaagaagaagauaaaauaa

SEQ ID NO: 4668 - RNA, 4014 nt, Artificial Sequence
  derived and/or modified CDS sequence (wt) from TOSV(SI-121283)__JF330279.1__GP
auguuuauugcaaaguuguuauuaauauccuguuuagugcagcaggccuaucugaaauacacuauuauuucagaaauagggaacggcacuagaacuucuuucuguuauagcucaagaaccaguuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuuggacagaguuuauuaauguggcaaaaccagcgaaugaaauggcuccuaugucaguuaucccaccaccaauugugaagcccauaccaguugcagaaucaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccauguacgcagaccaaauacaaccauagccccuacaaucauaacuacucugcucaugggcagugcaguaauggcagggccuuuggagaacagggaaccaacccacuuauuaaacaggccagggaauggggcuuacccccuaagugacuuugcugagcccaccugcacgcuagcuuauggcucagagugcaaauccugggagcaccaauuggacgagcugucuuuucccuucuuccacucuaaccuugacaaguacagcaugcuagaggcugcaacagagacaauaccaauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaagcucauugcauccuacgaaggcauagugcagucauagaagugaauguuaaugguguguggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuuuguguaccugccauacccaggaaacagcgagauuguuggaggugauauagggguccacaugacagaggaaucaucaccuucgaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaauuacaccccugugcuggcuaucaguauucuguggcuggaugaucagaagcuggaaaaagagagugggcucagcuaucucuaggaccaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuauguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucagaagggauaacagggaccaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggcagaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4669 - RNA, 4014 nt, Artificial Sequence
  derived and/or modified CDS sequence (wt) from TOSV(SI-121487)__JF330280.1__GP
auguuuauugcaaaguuguuauuaauauccuguuuagugcagcaggccuaucugaaauacacuauuauuucagaaauagggaacggcacuagaacuucuuucuguuauagcucaagaaccaguuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuuggacagaguuuauuaauguggcaaaaccagcgaaugaaauggcuccuaugucaguuaucccaccaccaauugugaagcccauaccaguugcagaaucaaccacuaagaaaaccaucccauuugauaaacuccuaucugaagcagagaaggaguugaaccaaacaaagaucauguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccaugugcgcagaccaaauacaaccauagccccuacaaucauaacuacucugcucauggccagugcaguaauggcaggaccuuuggagaacagggaaauaaaccacuuacuaaacuggccugggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccaauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaaaauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaagcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuaucucuagaaccaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuauguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucagaagggauaacagggacuaacgcauauuccuuuaugaagcaugggucaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuagaugacuaugaugugguguaccaaaauagccaguucgacugcucagcuacauuuaagaaucucaccggcuguuauucaugugaugaggguuccagaaugugcuaccaggugaaggcagaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaaaaggccaaugguaauaaaaagcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggugcaacaggcccugaaaaagaaaaacaaguaa

SEQ ID NO: 4670 - RNA, 4014 nt, Artificial Sequence
  derived and/or modified CDS sequence (wt) from TOSV(SI-21137)__EU003173.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaagacgccacaacugcagugaccuagaccggaagccauuuuggacagaguuuauuaauguggcaaagccagcgaaugaaauagcuccuaugucaguuaucccaccaccaauugugaagcccauaccaguugcagaaucaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccauguacgcagaccaaauacaaccauagccccuacaaucauaacuacucugcucauggccagugcaguaauggcaggaccuuuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccgauacucaacaagagcucagcugucugcacaauuuccccauccacgcauucaucgaaugcaugugguagggaagccagccucauaaagaagaaauguggaagcaauaugucggcuuucuucuauguuaaccuggcuggucagauaacuguugucaagugugacacaaaccaugucuugucuaacgacugugggaauuguaucucaaaaacccugagcggccagaagauuuacacuccaguucaggauauguucugucagaaaggcuggucagagaccaacccaagcacaagguacucaaaagaccucuguucuauuggcuugcacacugugaaggaauguaagauugguaccaccaacuuugagagagaggguuucauuguugugaaggggcgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaaaugcucuggggaugaauauuucugcaguagguacccaugugagacugcaaauguugaagcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuaucucuagaaccaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucaggagggauaacagggacuaacgcauauuccuuuaugaagcauggguuaggaagcuuugccaucauagaugacccauauucuccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4671 - RNA, 4014 nt, Artificial Sequence
  derived and/or modified CDS sequence (wt) from TOSV(SI-31051)__EU003174.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuugcacagaguuuauuaauguggcaaaaccagcgaaugaaauggcuccuaugucaguuaucccaccaccaauugugaagcccauaccaguugcagaaccaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuggauaagaugcucaagaagaaggagcgugaagaucugguggccagagaaaggguggaugaggauaugagaaaccauguacgcagaccaaauacaaccauagccccuacaaucauaacuacucugcucauggccagugcaguaauggcaggaccuuuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccaauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaagcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuaucucuagaacaaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucaggagggauaacagggacuaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4672 - RNA, 4014 nt, Artificial Sequence
  derived and/or modified CDS sequence (wt) from TOSV(SI-39538)__EU003175.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuuggacagaguuuauuaauguggcaaaaccagcgaaugaaauggcuccuaugucaguuaucccaccaccaauugugaagcccauaccaguugcagaaucaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccauguacgcagaccaaauacaaccauagccccuacaaucauaacuacucugcucauggccagugcaguaauggcaggaccuuuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcauguuagaggcugcaacagagacaauaccaauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaagcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuaucucuagaaccaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacaugaagucacuacccacucccggaaauucccaaugguucugauggcuaugagcacacaacccaccgacugggguuccauuggguuaauccuagauucaggagggauaacagggacuaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4673 - RNA, 4014 nt, Artificial Sequence
  derived and/or modified CDS sequence (wt) from TOSV(SI-40463)__EU003176.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggguugagguucucaaugaugucaucccagaugagcucaauccaggacgccacaacugcagugaccuagaccggaagccauuuuggacagaguuuauuaauguggcaaaaccagugaaugaaauggcuccuaugucaguuaucccaccaccaauugugaagcccauaccaguugcagaaucaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauugagaggaaagcucaugaauuagauaagaugcucaagaagaaggagcgugaagaucugguggccagagaaaggguggaugaggauaugagaaaccauguacgcagaccaaauacaaccauagccccuacaaucauaacuacucugcucauggccagugcaguaauggcaggaccuuuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccaauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaaguacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaagcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuaucucuagaaccaaugacacuauugguuggcgugacaauagucgacgugggcaagacauugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucaggagggauaacagggacuaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4674 - RNA, 4020 nt, Artificial Sequence
  derived and/or modified CDS sequence (wt) from TOSV(SI-40614)__EU003177.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacaucuggcacuuguaaagugggaucacuggaaaacagggauugcaaaagagacaucaugucaaauuauguugcagaagugcauuccaacuuacauggccuaggagcuaugaugcacaacuauggugaugacaagaggguugagguccucaaugaugucaucccagaugagcucaauccaggacgccacaacugcagugaccuggaccggaaaccauuuuggacagaguuuauuaauguggcaaagccagcaaacaaaauagcuccuauaucagugaucccaccaccaauugugaagcccauaccaauugcagaaucaacuaucaagaagaccaucccauuugauaaacuccuaucugaagcagaaaaggaguugaaccaaacaaaaaucagauuggaaaccgaaagaaggucuaaugcgggagaggcugcaagagaaagggccaggaugagagaaauugaagacaagcugagaaagaauugggagcuagaacgggagagaaaagaugcaguggcagacgaccuggcaaaagaaauagcgagaagaagagagauagagagaaaagcucaugaauuagauaagaugcucaagaagaaggagcgugaagaucagguggcaauagaaagggugagugaggauaugagaaaccaugugcguagaccaaauacaaccauagccccugcucccacgaucauuaccacccugcucauggccagugcgguaauggcaggaccuuuggagaacagggaaacaaaccacuuacuaaacaggccagggaauggagcuuauacccuaagugacuuugcugaguccaccugcacgcuagcuuauggcucagagugcaaauccugggagcaccaauuggaugagcugucuuuucccuucuuccacucuaaccuugacaaguacagcaugcuagaggcugcaacagagacaauaccgauacucaacaagagcucagcugucugcacaauuuccccauccacgcauucaucaaaugcauguggcagggaagcuagccucauaaagaagaaauguggaaacaauaugucugcuuucuucuauguuaaccuagccggccagauaacuguugucaagugugauacaaaccauguuuugucuaacgacugugggaauuguaucucaaaaaccuugagcggucagaagauuuauacuccaguucaggauauguucugucagagaggcuggacggaguccaucccaagcacaagguacucaaaagaccucuguucuauuggcuugcacacugugaaggaaugcaagacuggugccaccaacuuugagagaguagguuucauugucgugaagagucgaaagauguacauagagcagaugaagaugagaucaagacaagaauucagcgaagaccaguucuuaugcuacaaaucagagagcaguucuggcucuucuguaaaauuaaagaaggucaagguugagucaugcaaagguguuacaacaucaucagccuccaagugcucuggggaugaauauuucugcagcagguacccaugugaaacugcaaauguugaagcucauugcauuuuacgaaggcauagugcaguuauagaagugaaugucaauggcguguggguugugccgagaugcauugguuaugaagagguucuuguuagaaggacuucacucaaaauggaagauacaucuaguagagaaugugauaccugcuuaugggaaugcggaaaaaauaaacuaauugucaaaacucauggccccaaaauaguuuaugcaacagcauguagccaugggucuugcaagagugugaugcaaaagccagcgaccuucguguaccuaccguacccaggaaacagcgagauuguuggaggugauauagggguccacaugacagaggaaucaucacccucaaacauacacaugguggcacacugcccugcgaaggauuccugugagguuagcagcugccuauucugugugcacggacugcuuaauuaccagugccacaccuuguucucugcacuacuaauauccacuacugugauguccauucuuacauugcuacuucuucuugugaagggggcuaaagaucuugucaagaaauuauucuacuggcuaauuacaccccugugcuggcuaucaguguucuguggcuggaugaucaaaagcuggaaaaagagagugggcucagcuauuucuagaaccaaugacaccauugguuggcgugacaauagacgauaugggcgagacguugagagagcacaguacacaggaggaguuccaggggccaucuauucauuuuauggcgugaugauccuuggccuauuagguaaugugcauaguugcucugagagugucauagccgacuccaaagucaugcaaugcacaacuucgggaaguucuacccucugcaaggcuagugggacugugauuaugaagcuagggccuauaggcucagaguccugccugauuuugaagggucuuaaggacaaugaaaagcaauucaucucaaucaagacaauaucaagugaacucacaugccgagagggagaguccuucuggacuacucuauauacuccugucugucuaaguucgcgaaggugccaccuaaugggagaaugugucuccgaccgcugccucaaauggaaaaccaaugaaacaucuccagaauucacugggaaggcacauggagaaguuaugcaugagaauagaugcuuugagcagagcgguggaauaggcuacggaugcuuuaaugugaacccuucuugucucuacguccacuccauucucaaaucugucuacaagaauggauucaagaucuuuagauguguggcauggaaccacaggauuagacuugaaguuacuacccacucccggaaauucccaaugguuuugauggcuaugagcacacaacccacugacugggguucuauuggguuaauccuagauucagaagggauaacagggacuaacgcguauuccuucaugaagcacgggucaggaagcuuugccauuauagaugauccauauuccccagagccucguaaaggcuuuuuaggagaagugcgauguccaacagaagagacagcuauucgggcgucacccucauguaagauggcuccuaacuugauugaguaccagccugagauggacacugcagagugcacuacaaacaugauagaucccauggccauauucaaucgaggguccuugccacaaguucgggauggaaugacauucacacaaucaauugagaagaacacaguucaagcacugacaacaggggagguuagagcuuccauacgccuuacauuggacgacuaugaugugguguaucagaauagccaguccgacugcucagcuacauuuaagaaucucaccggcuguuauucaugugaugaggguucaagaaugugcuaccaggugaaggcagaaggagaaacuaucuuucacuuugucaaugaggaugaaucuaucaauguuauuaacaaggugagcccagacguaagugacuacugcacuguucuccacuucucaagaccuguuaucucuauugaagggagguaugacugcgggcuuagcaaaagaccaaugguaauaaaagguacucuaauugcuacugccccgcaugaugacaggaagcaugaaggagguuccucauugguugucaaccccaaaggcggcacaguugacuucuucgggugggugucuggacuaaccucauggcuaggugggccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4675 - RNA, 4014 nt, Artificial Sequence
  derived and/or modified CDS sequence (wt) from TOSV(SI-51903)__EU003178.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuuggacagaguuuauuaauguggcaaagccagcgaaugaaauagcuccuaugucaguuaucccaccaccaauugugaagccaauaccaguugcagaaucaaccacuaagaaaaccaucccauuugauaaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaagaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccauguacgcagaccaaaugcaaccauagccccuacaaucauaacuacucugcucauggccagugcaguaauggcaggaccucuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccgauacucaacaagagcucagcugucugcacaaucuccccauccacgcauucaucgaaugcaugugguagggaagccagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagacgaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccgugugagacugcaaauguugaggcccauugcauccuacgaaggcauagugcagucauagaagugaauguuaaugguguauggguugugccgagaugcauugguuaugaagagguccuuguaagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucacccucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaagagagugggcucagcuauuucuagaaccaaugacacuauugguuggcgugacaauagucgacgugggcaagacguugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucaggagggauaacagggacuaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugagggucccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaaaaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4676 - RNA, 4014 nt, Artificial Sequence
  derived and/or modified CDS sequence (wt) from TOSV(SI-68809)__EU003179.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcuuaauccaggacgccacaacugcagugaccuagaccggaagccauuuuggacagaguuuauugauguggcaaagccagcgaaugaaauagcuccuaugucaguuaucccaccaccaauugugaagccuauaccaguugcagaaucaaccauuaagaaaaccaucccauuugauaaacuccuaucugaagcagaggaggaguugaaccaaacaaagaucagguuggaaaccgaaagaagaucuaaugcggaagaggcugcuaaagaaagggccaggaugagagagauugaagacaagcugagaaaggauugggagcuggaacgggagaggaaagaugcaguggcagaggaccuagcaaaagaaauagcgagaagaagagaaauagagaggaaagcucaugaauuagauaagaugcucaaaaagaaggagcgugaggaucugguggccagagaaagggugaaugaggauaugaggaaccaugugcgcagaccaaauacaaccauagccccuacaaucauaacuacucugcucauggccagugcaguaauggcaggaccuuuggagaacagggagacaaaccacuuacuaaacaggccagggaauggggcuuacacccuaagugacuuugcugaguccaccugcacgcuagcuuauggcucagagugcaaauccugggagcaccaauuggaugagcugucuuuucccuucuuccacucuaaccuugacaaguacagcauguuagaggcugcaacagagacaauaccgauacucaacaagaguucagcugucugcacaauuuccccauccacgcauucaucaaaugcauguggcagggaagcuagccucauaaagaagaaauguggaagcaauaugucggcuuucuucuauguuaaccuggcuggucagauaacuguugucaagugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaaugcaagacugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacaacaucaucagccucuaagugcucuggggaugaauauuucugcaguagguacccaugugagacugcaaauguugaggcccauugcauccuacgaaggcauagugcagucauagaagugaauguuaaugguguauggguugugccgaggugcauugguuaugaagagguccuugucagaaggacuucacucaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaucacaccccugugcuggcuaucaguauucuguggcuggaugaucagaagcuggaaaaggagagugggcucagcuauuucuagaaccaaugacacuauugguuggcgugacaauagucgacgugggcaagacguugagagagcacaguacacaggaggagcuccaggggcuaaauauucauuuuauggagugaugauccuuggccuauuaggugaggugcauagcugcucugagaguaucauagccgauuccaaaaucaugcaaugcacaacuucgggaaguucuacccucugcaaggcuagugggacugugauuaugaagcuagggccuauaggcucagaguccugccugauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucaaauggaagaccaaugaaacaucugcagaauucacugggaaggcacauggagaaguuaugcaugagaauagaugcuuugagcagagcgguggaauaggcuauggaugcuuuaaugugaacccuucuugucucuacguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuggauucaggagggauaacagggacuaacgcauauuccuuuaugaagcauggguuaggaagcuuugccaucauagaugacccauauuccccagagccucgcaaaggcuuuuuaggagaagugcgauguccaacagaagagacagcuauucgggcgucacccucauguaagauggccccuaacuugaucgaguaccagccugaaauggacacugcagagugcaccacaaauaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuacucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaaaaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4677 - RNA, 4014 nt, Artificial Sequence
  derived and/or modified CDS sequence (wt) from TOSV(SI-76082)__EU003180.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacgucuggcacuuguaaagugggaucacuggagaacagagagugcaaaagagacaucaugucuaauuauguugcagaagugcauuccaacuuacauggcuuaggagcuaugaugcacaacuauggugaugacaagaggauugagguccucaaugaugucaucccagaugagcucaauccaggacgccacaacugcagugaccuagaccggaagccauuuuggacagaguuuauuaauguggcaaaaccagcgaaugaaauggcuccuaugucaguuaucccaccaccaauugugaagcccauaccaguugcagaaucaaccacuaagaaaaccaucccauuugaugaacuccuaucugaagcagagaaggaguugaaccaaacaaagaucagguuggaaaccgaaagaagaucuaaugcggaagaggcugcuaaagaaagggccaggaugagagagauugaagacaagcugagaaaggauugggaacuggaacgggagaggaaagaugcaguggcagaggaccuagcaaaagaaauagcgaggagaagagaaauagagaggaaagcucaugaauuagauaagaugcucaagaagaaggagcgugaagaucugguggccagagaaaggguggaugaggauaugagaaaccauguacgcagaccaaauacaaccauagccccuacaaucauaacuacucugcucauggccagugcaguaauggcaggaccuuuggagaacagggaaacaaaccacuuacuaaacaggccagggaauggggcuuacacccuaagugacuuugcugaguccaccugcacgcuagcuuauggcucagagugcaaauccugggagcaccaauuggacgagcugucuuuucccuucuuccacucuaaccuugacaaguacagcaugcuagaggcugcaacagagacaauaccaauacucaacaagagcucagcugucugcacaaucuccccauccacgcauucaucaaaugcauguggcagggaagcuagccucauaaagaagaaauguggaagugauaugucggcuuucuucuauguuaaccuggcuggucagauaacuguugucaaaugugacacaaaccaugucuugucuaacgacugugggaauuguaucucaaaaacccugagcggccagaagauuuacacuccaguucaggauauguucugucagaaaggcuggucagaguccaucccaagcacaagguacucaaaagaccucuguucuauuggcuugcacacugugaaggaauguaagauugguaccaccaacuuugagagaguggguuucauuguugugaagggucgaaagauguacauugagcagaugaagaugagaucgaggcaagaauucagcgaagaccaguucuuaugcuacaaaucagagggcaguucuggcucuucuguaaaacuaaagaagguuaagguugagucaugcaaagguguuacuacaucaucagccucuaagugcucuggggaugaauauuucugcaguagguacccaugugagacugcaaauguugaggcccauugcauccuacgaaggcauagugcagucauagaagugaauguuaaugguguauggguugugccgagaugcauugguuaugaagagguccuugucagaaggacuucacuuaaaguggaagauacaucuaguagagaaugugauaccugcuuaugggaaugcgggaaaaauaaacuaauugucaaaacucauggccccaaaauaguuuaugcaacagcguguagccaugggucuugcaagagugugaugcaaaagccagcgaccuucguguaccugccauacccaggaaacagcgagauuguuggaggugauauagggguccacaugacagaggaaucaucaccuucaaacauacacaugguggcacacugcccugcgaaggacuccugugagguuagcagcugccuauucugugugcacggacugcuuaacuaccagugccacaccuuguucucugcacuacuaauauccaccacugugauguccauucuuacacugcuacuucuucuugugaagggagcuaaggaucuuguuaagagauuguucuacuggcuaaugacaccccugugcuggcuaucaguauucuguggcuggaugaucagaagcuggaaaaagagagugggcucagcuaucucuagaaccaaugacacuauugguuggcgugacaauagucgacgugggcaagacguugagagagcacaguacacaggaggagcuccaggggcuaaauauucauuuuauggagugaugauccuuggccuauuagguaaugugcauagcugcucugagaguaucauagccgauuccaaaaucaugcaauguacaacuucgggaaguucuacccucugcaaggcuagugggacugugauuaugaagcuagggccuauaggcucagaguccugccuaauucugaagggucuuaaggacagcgaaaagcaauuuaucucaauuaagaccauaucaagugagcucacaugccgagagggagaguccuucuggacuacucuauauacuccugucugucuaagcucgcgaaggugccaccugaugggagaaugugucuccgaccgcugccucagauggaagaccaaugaaacaucugcagaauucacugggaaggcacauggagaaguuaugcaugagaauaggugcuuugagcagagcgguggaauaggcuauggaugcuuuaaugugaacccuucuugucucuauguccauuccuaucucaaaucugucuacaagaauggauuuaagaucuuuagauguguggcauggaaccauaggauuagacuugaagucacuacccacucccggaaauucccaaugguucugauggccaugagcacacaacccaccgacugggguuccauuggguuaauccuagauucaggagggauaacagggacuaacgcauauuccuuuaugaagcauggguuaggaagcuuugccaucauagaugacccauauuccccagagccucguaaaggcuuuuuaggagaagugcgauguccaacagaagagacagcuauucgggcgucacccucauguaagauggcuccuaacuugaucgaguaccagccugaaauggacacugcagagugcaccacaaacaugauagaucccauggccauauucaaucgaggguccuugccacaaguccgggauggaaugacauucacacaaucaauugagaagaacacaguucaagcacugacaacaggggagguuagagcuuccauacgccucacauuggaugacuaugaugugguguaccaaaauagccaguucgacugcucagcuacauuuaagaaucucaccggcuguuauucaugugaugaggguuccagaaugugcuaccaggugaaggccgaaggagaaaccaucuuccacuuugucaaugaggaugaauccaucaaugucaucaacaaggugagcccagacguaagugacuacugcacuguucuccacuucucaagaccugucaucucuauugaagggagguaugacugcgggcuuagcaagaggccaaugguaauaaaaggcacucuaauugccacugccccgcaugaugauaggaagcaugaaggaggcuccucauugguugucaaccccaaaggcggcacaguugacuucuucggaugggugucuggacuaaccucauggcuagguggaccucugaaaaccuucuugaccauccuuggauuccuagcucugggccuacuuuuaguagugauaaucaucaucauugcucgcacuggggucgaacaggcccuaaaaaagaaaaacaaguaa

SEQ ID NO: 4678 - RNA, 4020 nt, Artificial Sequence
  derived and/or modified CDS sequence (wt) from TOSV(TOSV/Mantova.ITA/2013)__KM507329.1__GP
auguuuauugcaaaguuguuauuaauuuccuguuuagugcagcaggccuaucugaaauacacuauuauuucagaaauagggaacggcacuagaacuucuuuuuguuauagcucaaggaccagcuuggggagccuccuggaagcuugggacaacauaacugagucuauuggucugacaucuggcacuuguaaagugggaucacuggaaaacagggauugcaaaagagacaucaugucaaauuauguugcagaagugcauuccaacuuacauggccuaggagcuaugaugcacaacuauggugaugacaagaggguugagguccucaaugaugucaucccagaugagcucaauccaggacgccacaacugcagugaccuggaccggaaaccauuuuggacagaguuuauuaauguggcaaagccagcaaacaaaauagcuccuauaucagugaucccaccaccaauugugaagcccauaccaauugcagaaucaacuaucaaggaaaccaucccauuugaaaaacuccuaucugaagcagaaaaggaguugaaccaaacaaaaaucagauuggaaaccgaaagaaggucuaaugcggaagaggcugcaagagaaagggccagggugagagaaauugaagacaagcugagaaagaauugggagcuagaacgggagagaaaagaugcaguggcagacgaccuggcaaaagaaauagcgagaagaagagagauagagagaaaagcucaugaacuagauaagaugcucaagaagaaggagcgugaagaucagguggcaauagaaagggugagugaggauaugagaaaccaugugcguagaccaaauacaaccauagccccugcucccacgaucauuaccacccugcucauggccagugcgguaauggcaggaccuuuggagaacagggaaacaaaccacuuacuaaacaggccagggaauggagcuuauacccuaagugacuuugcugaguccaccugcacgcuagcuuauggcucagagugcaaauccugggagcaccaacuggaugagcugucuuuucccuucuuccacucuaaccuugacaaguacagcaugcuagaggcugcaacagagacaauaccgauacucaacaagagcucagcugucugcacaauuuccccauccacgcauucaucaaaugcauguggcagggaagcuagccuuauaaagaagaaauguggaaacaauaugucugcuuucuucuauguuaaccuagccggccagauaacuguugucaagugugauacaaaccauguuuugucuaacgacugugggaauuguuucucaaaaaccuugagcggucagaagauuuauacuccaguucaggauauguucugucagagaggcuggacggaguccaucccaagcacaagguacucaaaagaccucuguucuauuggcuugcacacugugaaggaaugcaagacugguaccaccaacuuugagagaguagguuucauugucgugaagagucgaaagauguacauagagcagaugaagaugagaucaagacaagaauucagcgaagaccaguucuuaugcuacaaaucagagagcaguucuggcucuucuguaaaauuaaagaaggucaagguugagucuugcaaagguguuacaacaucaucagccucuaagugcucuggggaugaauauuucugcagcagguacccaugugaaacugcaaauguugaagcucauugcauuuuacgaaggcauagugcaguuauagaagugaaugucaauggcguguggguugugccgagaugcauugguuaugaagagguucuuguuagaaggacuucacucaaaauggaagauacaucuaguagagaaugugauaccugcuuaugggaaugcggaaaaaauaaacuaauugucaaaacucauggccccaaaauaguuuaugcaacagcauguagccaugggucuugcaagagugugaugcaaaagccagcgaccuucguguaccuaccguacccaggaaacagcgagauuguuggaggugauauagggguccacaugacagaggaaucaucaccuucaaauauacacaugguggcacacugcccugcgaaggauuccugugagguuagcagcugccuauucugugugcacggacugcuuaauuaccagugccacaccuuguucucugcacuacuaauauccacuacugugauguccauucucacauugcuacuucuucuugugaagggggcuaaagaucuugucaagaaauuauucuacuggcuaauuacaccccugugcugguuaucaguguucuguggcuggaugaucaaaagcuggaaaaagagagugggcucagcuauuucuagaaccaaugacaccauugguuggcgugacaauagacgauaugggcgagacguugagagagcacaguacacaggaggagcuccaggggcuaaauauucauuuuauggagugaugauccuuggccuauuagguaaugugcauaguugcucugagagugucauagccgacuccaaagucaugcaaugcacaacuucgggaaguucuacccucugcaaggcuagugggacugugauuaugaagcuagggccuauaggcucagaguccugccugauuuugaagggucuuaaggacaaugaaaagcaauucaucucaaucaagacaauaucaagugaacucacaugccgagagggagaguccuucuggacuacucuauauaccccugucugucuaaguucgcgaaggugccaccuaaugggagaaugugucuccgaccgcugccucaaauggaaaaccaaugaaacaucugcagaauucacugggaaggcacauggagaaguuaugcaugagaauagaugcuuugagcagagcgguggaauaggcuauggaugcuuuaaugugaacccuucuugucucuacguccauucuuaucucaaaucugucuacaagaauggauucaagaucuuuagauguguggcauggaaccacaggauuagacuugaaguuacuacccacucccggaaauucccaaugguuuugauggcuaugagcacacaacccacugacugggguucuauuggguuaauccuagauucagaagggauaacagggacuaacgcguauuccuucaugaagcacgggucaggaagcuuugccauuauagaugacccauauuccccagagccucguaaaggcuuuuuaggagaagugcgauguccaacagaagagacagcuauucgggcgucacccucauguaagauggcuccuaacuugauugaguaccagccugagauggacacugcagagugcacuacaaacaugauagaucccauggccauauucaaucgaggguccuugccacaaguucgggauggaaugacauucacacaaucaauugagaagaacacaguucaagcacugacaacaggggagguuagagcuuccauacgucuuacauuggacgacuaugaugugguguaucagaauagccaguccgacugcucagcuacauuuaagaaucucaccggcuguuauucaugugaugaggguucaagaaugugcuaccaggugaaggcagaaggagaaacuaucuuucacuuugucaaugaggaugaaucuaucaauguuauuaacaaggugagcccagacguaagugacuacugcacuguucuccacuucucaagaccugucaucucuauugaagggagguaugacugcgggcuuagcaaaagaccaaugguaauaaaagguacucuaauugcuacugcuccgcaugaugacaggaagcaugaaggagguuccucauugguugucaaccccaaaggcggcacaguugacuucuucgggugggugucuggacuaaccucauggcuaggugggccucugaaaaccuucuugaccauccuuggauuccuagcucugggccuacuuuuaguagugauaaucaucaucauugcucgcacuggggugcaacaggcccuaaaaaagaaaaacaaguaa

SEQ ID NO: 4679 - RNA, 4020 nt, Artificial Sequence
  derived and/or modified CDS sequence (wt) from TOSV(TOSV/Phl.233/FR/2009)__HQ184337.1__GP
auguuuauugcaaaguuguuauuaauuuccuguuuagugcagcaggccuaucugaaauauacuauuauuucagagacagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagccccagccaccugcagaaccauccuccaagaaacauguuccguuugauguacuuuugucagaagcugagaaggagcuaaaccagacaaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauaaaaugcuuaaaaagaaggagcgcgaaagccugauugcaaaagagaaagcagaugaggacaugagaagccaugugcauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacauuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccaucucuccuuccacacauucaucgaaugccugugggagagaggcuagugucauuaggaagaaauguuauaguaacaugucagccuucuucuacauuaaccuggcaggucaaauuacugugauuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguucaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauucacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauucaagaaccucacugguuguuacucaugugaugaaggauccagacuaugcuaucaagugaaggcagaaggcgagacuauuuuucacuuuauuaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4680 - RNA, 4020 nt, Artificial Sequence
  derived and/or modified CDS sequence (wt) from TOSV(TOSV/Phl.51/FR/2009)__HQ184336.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagcuccagccaccugcagaaccauccuccaagaaacauguuccguuugauguacuuuugucagaagcugagaaggagcuaaaccagacaaaaauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagauaggaaggcccaugagcuugauagaaugcuuaaaaagaaggagcgcgaaagccugauugcaaaagagaaagcagaugagaacaugagaagccaugugcaugaaccaaacacgacuagagccccagcacccacaauuaucaccacucugcucauggcaagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugguuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguuuccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacagaaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuuugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgaugccucaaguggaagacuaaucaaacauccgcagaauucacagggaaagcacauggugacgucaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugguugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauuuaagaaccucacugguuguuacucaugugaugaaggauccagacuaugcuaucaagugaaggcagaaggcgagacuauuuuucacuuuauuaaugaagaagaguccaucaaugucaucaauaagguaagcccgagagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4681 - RNA, 4020 nt, Artificial Sequence
  derived and/or modified CDS sequence (wt) from TOSV(11368)__KU925897.1__GP
auguuuauugcaaaguuguuauuaauuuccuguuuagugcagcaggccuaucugaaauauacuauuauuucagagacagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauggucccaaugucagugauuccaccaccaguugugaagcuccagccaccugcagaaccauccuccaagaaacauguuccguuugauguacuuuugucagaagcugagaaggagcuaaaccagacaaagauuagacuggaagaugagagaaaguccaauacagaagagacagcaaaggagagggccaggaugaaggagauugaggaugaauugagaagggagugggagcuggaacggaagaggaaggacgcaauggcagaugauuuagcaaaagaaacagcaagaaggagggagauagaaaggaaggcccaugagcuugauaaaaugcuuaaaaagaaggagcgcgaaagccugauugcaaaagagaaagcagaugaggacaugagaagccaugugcauaaaccaaacacgacuagagcccuagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugauuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguucaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucaguuuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacaugccgagaaggagaaucuuucuggaccacccuauacacaccuaucugcuuaagcucaagaagaugucacuugaugggagaaugugucucugaucgcugccucaaguggaagacuaaucaaacauccgcagaauucacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaaccugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucauauuagaugauuaugaugugguguaucaaaauagccagucugacugcucagccacauucaagaaccucacugguuguuacucaugugaugaaggauccagacuaugcuaucaagugaaggcagaaggcgagacuauuuuucacuuuauuaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4682 - RNA, 4020 nt, Artificial Sequence
  derived and/or modified CDS sequence (wt) from TOSV(5904242804)__KU935737.1__GP
auguuuauugcaaaguuguuauuaauuuccuguuuagugcagcaggccuaucugaaauacacuauuauuucagagauagggaacggcacuagaacuucuuuuuguuauagcucaagaacuaguuuggggagccuccuggaagcuugggacaacauaacugagucuauuggucugacgucuggcacuuguaaagugggaucacuggagaacagggauugcaaaagagacaucaugucaaauuauguugcagaagugcauuccaacuuacauggccuaggagcuaugaugcacaacuauggugaugacaagaggguugagguccucaaugaugucaucccagaugagcucaauccaggacgucacaacugcagugaccuagaccggaagccauuuuggacagaguucauugauguggcgaagccaacgaacaaaauagcuccuaugucagugaucccaccaccaauugugaaacccauaccaguugcagaaucaaccauuaagaaaagcaucccauuugauaaacucuuaucugaagcagaaaaggaguugaaccaaacuaaaaucagauuggaaaccgaaagaaggucuaaugcagaagaagcugcaaaagaaagggccaggaugagggaaauugaagacaagcugagaaaggacugggagcuggaacgggagagaaaagaugcaguggcagacgaccuggcaaaagaaauagcgagaagaagagagauagagagaaaagcucaugaauuagauaagaugcucaagaagaaggagcgugaagaucugguggcaagagaaagggugagugaggauaugagaaaccaugugcguaaaccaaauacaaccauagccccugcucccacaaucauuacuacccugcucauggccagugcaguaauggcaggaccuuuggagaacagggaaacaaaccacuuacuaaacaggccagggaauggagcuuacacccuaagugacuuugcugaguccaccugcacgcuagcuuauggcucagagugcaaauccugggagcaccaacuggaugagcugucuuuucccuucuuccacucuaaccuugacaaguacagcaugcuggaggcugcaacagagacaauaccgauacucaacaagagcucagcugucugcacaauuuccccauccacgcacucaucgaaugcaugugguagggaagccagccucauaaagaagaaauguggaagcaauaugucggcuuucuuuuauguuaaccuagccggucagauaacuguugucaagugugauacaaaccaugucuugucuaacgacugugggaauuguaucucaaaaaccuugagcggccagaagauuuauacuccaguucaggauauguucugucagaaggguuggacagaguccaucccaaacacaagguacucaaaagaccucuguucuauuggccugcauacugugaaagaaugcaagacugguaccaccaacuuugagagaguggguuucauuguuguggagggucggaagauguacauugagcagaugaagaugagaucgaggcaagaauucagcgaagaccaguucuuaugcuacaaaucagagagcaguuccggcucuucugugaaacuaaagaaggucaagguugagucaugcaaaggugucacaacaucaucagccucuaagugcucuggggaugaauauuucugcagcagguacccaugugaaacugcaaauguugaagcccacugcauucuucgaaggcauagugcaguuauagaagugaaugucaaugguguauggauugugccgagaugcauugguuaugaagagguucuugucagaaggacuucauuaaaaguugaagauacgucaaguagagaaugugauaccugcuuaugggaaugcgggaaaaauaaacuaauuguuaaaacucauggcccuaaaauaguuuaugcaacagcauguagccaugggucuugcaaaagugugaugcaaaagccagcaaccuucguguacuugccguacccaggaaacagcgagauuguuggaggugauauagggguccacaugacagaggaaucaucaccuucaaacauacacaugguggcacacugcccugcaaaggauucuugugagguuagcagcugccuauucugugugcacggacugcuuaauuaccagugccacaccuuguucucugcauuacuaauauccaccacugugauguccauucuuacacugcuacuucuucuugugaagggagcuaaagaucuugucaagagauuguucuacuggcuaaucacaccccugugcuggcuaucaguguucuguggcugggugaucaaaagcuggaaaaagagagugggcucagcuauuucuaggaccaaugacaccaucgguuggcgagacaauagacgauacaggcaagacgucgagagagcacaguacacaggaggagcuccaggggcuaaauacucauuuuauggaguaaugguccuuggccuauuagguaaugugcauaguugcucugagaguaucauagcugacuccaaaaucaugcaaugcacaacuucgggaaguucuacccucugcaaggcuagugggacuguaauuaugaagcuagggccuauaggcucggaguccugccugauucugaagggucucaaggauagugagaaacaauuuaucucaaucaagaccauaucaagugaacucacaugccgagagggagaguccuucuggacuacucuauauacuccugucugucuaagcucgcgaaggugccaccugaugggagaaugugucuccgaccgcugccucaaauggaaaaccaaugaaacaucugcagaauucacugggaaggcacauggagagguugugcaugagaauaggugcuuugagcagagcgguggaauaggcuacggaugcuuuaaugugaacccuucuugucucuacguccauuccuaucucaaaucugucuacaagaauggauuuaagaucuuuagauguguggcauggaaccauaggauuagacuugaaguuacuacccacucccggaaauucccaaugguuuugauggcuaugagcacacaaccgacugacugggguucuauuggguuaaucuuagauucagaagggauaacagggacuaacgcguauuccuuuaugaagcacgggucaggaagcuuugccaucauagaugacccauauuccccagagccucguaaaggcuuuuuaggagaagugcgauguccaacagaagaaacagcuauucgggcgucacccucauguaagauggccccuaacuugaucgaguaccagccugagauggacacugcagagugcacuacaaacaugauagaccccauggccauauucaaucgaggguccuugccacaaguccgagauggaaugacauucacacaaucaauugagaagaacacaguucaagcacugacaacaggggagguuagagcuucuauacgccucacauuggacgacuaugaugugguguaccaaaauagccaguccgacugcucagcuacauuuaagaaucucaccggcuguuauucaugugaugaggguuccagaaugugcuaccaggugaaggcagaaggagaaacuaucuuucacuuuaucaaugaggaugaauccaucaaugucauuaacaagguaaacccagacguaagugacuacugcacuguucuccacuucucaagaccugucaucucuauugaagggagguaugacugcgggcuuagcaaaagaccaaugguaauaaaagguacucuaauugcuacugccccgcaugaugacagaaagcaugaaggaggcuccucauugauugucaaccccaaaggcggcacaguugauuucuucggaugggugucuggacuaaccucauggcuagguggaccucugaaaaccuuccugaccauccuuggauuccuagcucugggccuacuuuuaguagugauaaucaucaucauugcucgcacuggggugcaacaggcccuaaaaaagaaaaacaaguaa

SEQ ID NO: 4683 - RNA, 4020 nt, Artificial Sequence
  derived and/or modified CDS sequence (wt) from TOSV(5963930705)__KU935734.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuagagaacagggacugcaggaaagacauaauguccaacuacguugcugaggugcacucuaaccugcacggacugggagcuaugaugcacaacuacggugaugacaagaggguugagauccucaaugaugucauaccagaugagcucaauccuggacaucacaacuguagugaccuugaccgaaagccauuuuggacugaguuuauuaauguggcaaagccauugggugaaauagucccaaugucagugauuccaccaccaguugugaagcuccagccaccugcagaaccauccuccaagaaacauguuccguuugauguacuuuugucagaagcugagaaggagcuaaaccagacgaagauuagacuggaagaugagagaaaguccaaugcagaagagacagcaaaggagagggcuaggaugaaggagauugaggaagaauugagaagggagugggagcuggaacggaagaggaaggacgcaauggcagaugaucuagcaaaagaaacagcaagaaggagggagauagaaaggaaggcccaugagcuugauagaaugcuuaaaaagaaggagcgcgaaagccugauugcaaaagagaaagcagaugaggacaugagaagccaugugcauaaaccaaacacgacuagagccccggcacccacaauuaucaccacucugcucauggcgagugcagcccuagcgggaccccuggaaaacagggagacaaaucauuugcucaacaggccaggaaauggggcuuacacucuaagcgacuuugcugaaucaaccugcacacuggccuauggaucagaauguaaaucuugggagcaccuucugaaugaggagcuguuccccuucuuccauucuaaucuugacaaguacagcaugcuagaagcugcaacagagacaguaccuauacuuaauaagagcucugcaguuugcaccauuucuccuuccacacauucaucgaaugccugugggagagaggcuagugucauuaggaagaaauguuauaguaacaugucagccuucuucuacaucaaccuggcaggucaaaucacugugguuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuucugugcuauaaaucagaaagcggcucuggcucaucugucaagcuaaagaaguucaagguugaaucaugcaaggguguuacuacaucaucagccucuaagugcucuggcgaugaguauuucugcagcagguauccaugugaagcagccaacguugaagcccacugcauucuaaggaggcauagugcaauaguggaagugaaugucaacggcguguggguugugcccagguguauuggcuaugaggagguucuggucaaaaggacaucacucaagguugaagauacgacagaaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaaccacugugaugucaauucucacauugcugcucuugcuugugaaaggggcaaaggaucuuguuaagaaauuguuccacuggcugaucacuccuuuaugcuggcuaucagucuuuugcugcuggaugguuaaaagcuggaaaagaagaguggguucagcaauuucuaggacaaacgacacuauugguuggcgugaaaacaggcggcaugcucaagacauugagagagcacagcacacgggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuauuaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauuuacagggaaagcacauggugacguuaugcacgagaacagaugcuuugagcaaaguggaggaauaggcuacggauguuuuaacguaaacccuucuugucucuauguccacucuuaucucaagucuguuuacaggaauggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcggugcccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggagaaguuaaggcauccauccgccucacauuagaugauuaugaugugguguaucaaaauagccagucugacugcucagccacuuuuaagaaccucacugguuguuacucaugugaugaaggauccagacuaugcuaucaagugaaggcagaaggcgagacuauuuuucacuuuaucaaugaagaagaguccaucaaugucaucaauaagguaagcccgggagugagcgacuacugcaccguucuccauuucucaaguccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguuaguggugauaauuaucaucaucauucgaacuggaaugcaacaagcuuugaagaagaagauaaaauaa

SEQ ID NO: 4684 - RNA, 4020 nt, Artificial Sequence
  derived and/or modified CDS sequence (wt) from TOSV(H4906)__KU922125.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccacugagugaaauagucccaaugucagugauuccaccaccaguugugaagccccagccaccugcagaaccauccuccaagaaacauguuccguuugauguacuuuugucagaagcugagaaggagcuaaaccagacgaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauagaaugcuuaaaaagaaggagcgcgaaagccugauugcaaaagagaaagcagaugaggacaugagaagccaugugcauaaaccaaacacgacuagagccccagcacccacaauuaucaccacucuacucauggcgagugcagcccuagcggggccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugguuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguuuccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacagaaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaacuucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauuuacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagagaugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauuuaagaaccucacugguuguuacucaugugaugaaggauccagacuaugcuaucaagugaaggcagaaggcgagacuauuuuucacuuuaucaaugaagaagaguccaucaaugucaucaauaagguaaacccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguuaguggugauaauuaucaucaucauucggacuggaaugcaacaagcuuugaagaagaagauaaaauaa

SEQ ID NO: 4685 - RNA, 4020 nt, Artificial Sequence
  derived and/or modified CDS sequence (wt) from TOSV(MRS2010-4319501)__KC776215.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggucugauuucuggcacuugcaaaguggggucacuggagaacagggacugcaggaaagacauaauguccaacuacguugcugaggugcacucuaaccugcacgggcugggagcuaugaugcacaacuacgcugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagcuccagccaccugcagaaccauccuccaagaaacauguuccguuugauguacuuuuaucagaagcugagaaggagcuaaaccagacgaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauagaaugcuuaaaaagaaggagcgcgaaagccugauugcaaaagagaaagcagaugaggacaugagaagccauguguauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauagcaacaugucagccuucuucuacauuaaccuggcaggucaaauuacugugguuaagugugaaacaaaccacguccuuucuagugauuguggaaauugcaucucuaagagcuugaguggccaaaagguguacaccccagugcaagauguguucugucagaagggcuggacacaguccaucccaagcacaaaguauucaaaagacaucuguucuauugguuugcacaccgugaaggaaugcaagauaggaaucacuagcuuugagaggguggguuucauaguugugaaaggccgcaagauguacauugagcagaugaagaugagaucaaggcaggaauacagcgaagaucaauuuuugugcuauaaaucagaaagcagcucuggcucaucugucaagcuaaagaaguucaagguugaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauuuugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaagagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagagugggacccauaggcucagagucuuguuugauucugaaagggcucaaggacagugaaaagcaguucauaucuaucaagaccauaucaagugaacucacgugccgagaaggagaauccuucuggacuacccuauacacaccuaucugcuuaagcucaagaagaugucacuugaugggagaaugugucucugaucgcugccucaaguggaagacuaaucaaacauccgcagaauucacagggaaagcacauggugacguuaugcacgagaacagaugcuuugagcaaaguggaggaauaggcuacggauguuuuaauguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugaguacacagcccacugacuggggauccauugguuugauucuugacucagaagggguaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaccagccugaaauggacacagcagaguguaccacaaauaugauagacccuauggcuauauucaaucgaggaucucugccacagguucgggauggaaugacuuucacgcagucaauagaaaagaacacuguucaggcauuaacaacaggggaaguuaaggcauccauccgccucacauuagaugauuaugaugugguguaucaaaauagccagucugacugcucagccacauuuaagaaccucacugguuguuacucaugugaugaaggauccagacuaugcuaucaagugaaggcagaaggcgagacuauuuuucacuuuaucaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguuaguggugauaauuaucaucaucauucggacuggaaugcaacaagcuuugaagaagaagauaaaauaa

SEQ ID NO: 4686 - RNA, 4020 nt, Artificial Sequence
  derived and/or modified CDS sequence (wt) from TOSV(Nice/113)__KU204982.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuagagaacagggacugcgggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaggccauuaagugaaauagccccuaugucagugauuccaccaccaguugugaagcuccagccaccugcagaaccauccuccaagaaacauguuccguuugauguacuuuugucagaagcugagaaggagcuaaaccagacgaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauagaaugcuuaaaaagaaagagcgcgaaagccugauugcaaaagagaaagcagaugaggacaugagaagccaugugcauaaaccaaacacgacuagagccccagcacccacaauuaucaccacucugcucauggcgagugcagcccuagcgggaccccuggagaacagggagacaaaucauuugcucaauaggccaggaaauggggcuuacacucuaagcgacuuugcugaaucaaccuguacacuggccuaugggucagaaugcaaaucuugggagcaccuucugaaugaggagcuguuccccuucuuccauucuaaucuugacaaguacagcaugcuagaagcugcaacagagacaguaccuauacuuaauaagagcucugcaguuugcaccauuucuccuuccacacauucaucgaaugccugugggagagaggcuagugucaucaggaagaaauguuauaguaacaugucagccuucuucuacauuaaccuggcaggucaaaucacugugguuaagugugaaacaaaccacguccuuucuagugauuguggaaauugcaucucuaagagcuugaguggccaaaagguauacaccccagugcaagauguauucugucagaagggcuggacacaguccaucccaagcacaagauauucaaaagacaucuguucuauagguuugcacaccgugaaggaaugcaagauaggaaccacuagcuuugagaggguggguuucauaguugugggaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacagaaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucaccuucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguucuacuggcugaucacuccuuuaugcuggcuaucagucuuuugcugcugggugauuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggacuacccuauacacaccuaucugcuuaagcucaagaagaugucacuugaugggagaaugugucucugaucgcugccucaaguggaagacuaaucaaacauccgcagaauuuacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauuggcuugauucuugacucagaggggauaacaggaacaaacucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauuuaagaaccucacugguuguuacucaugugaugaaggauccagacuaugcuaucaagugaaggcagaaggcgagacuauuuuucacuuuaucaaugaagaagaguccaucaaugucaucaauaaggugagcccggaagugagcaacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuucggaugguugucuggauugaccucauggcucggagguccucucaaaacauuucugacuauucuuggguuccuagcugugggcuuacuguuaguggugauaauuaucaucaucauucgaacuggaaugcaacaagcuuugaagaagaagauaaaauaa

SEQ ID NO: 4687 - RNA, 4020 nt, Artificial Sequence
  derived and/or modified CDS sequence (wt) from TOSV(P233)__KU204976.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagccccagccaccugcagaaccauccuccaagaaacauguuccguuugauguacuuuugucagaagcugagaaggagcuaaaccagacaaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauaaaaugcuuaaaaagaaggagcgcgaaagccugauugcaaaagagaaagcagaugaggacaugagaagccaugugcauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacauuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccaucucuccuuccacacauucaucgaaugccugugggagagaggcuagugucauuaggaagaaauguuauaguaacaugucagccuucuucuacauuaaccuggcaggucaaauuacugugauuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguuaaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguuccacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauucacagggaaagcacauggugacguuaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauucaagaaccucacugguuguuacucaugugaugaaggauccagacuaugcuaucaagugaaggcagaaggcgagacuauuuuucacuuuauuaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4688 - RNA, 4020 nt, Artificial Sequence
  derived and/or modified CDS sequence (wt) from TOSV(T152)__JX867535.1__GP
auguuuauugcaaaguuguuauuaauuuccuguuuagugcagcaggccuaucugaaauacacuauuauuucagaaauagggaacggcacuagaacuucuucuuguuauagcucaagaaccagcuuggggagccuccuggaagcuugggacaacauaacugagucuauuggucugacaucuggcacuugcaaagugggaucacuggaaaacagggauugcaaaagagacaucaugucaaauuauguugcagaagugcauuccaacuuacacggccuaggagcuaugaugcacaacuauggugaugacaagaggguugagguccucaaugaugucaucccagaugagcucaauccaggacgccacaauugcagugaccuagaccggaagccauucuggacagaguuuauuaauguggcaaagccaacgaauaaaauagcucccauaucagugaucccaccaccaauugugaagccuauaccaauugcagaaccaaccacuaagaaaaacaucccauuugauaaacuccuaucugaagcagaaaaggaguugaaccaaacaaaaaucagauuggaaaccgaaagaaggucuaaugcggaagaggcugcaaaagagagggccaggaugagagaaauugaagacaagcugagaaaggauugggagcuggaacgagagagaaaagaugcaguggcggacgaccuggcaaaagaaauagcgagaagaagagagauagagagaaaagcucaugaauuagauaagaugcucaagaagaaggagcgugaggaucugguggcaauagaaaaggugagugaggauaugagaaaccauguacguagaccaaauacaaccauagccccugcucccacgaucauuacuacccugcucuuggccagugcaguaauggcaggaccuuuggagaacagggaaacaaaccacuuacuaaacaggccagggaauggagcuuacacccuaagugacuuugcugaguccaccugcacgcuagcuuauggcucagagugcaaauccugggagcaccaauuggaugagcugucuuuucccuucuuccacucuaaccuugacaaguacagcaugcuagaggcugcaacagagacaauaccaauacucaacaagagcucagcugucugcacaauuuccccaucaacgcauucaucaaaugcauguggcagggaagccagccucauaaagaagaaauguggaagcaauaugucggcuuucuucuauguuaaccuagccggucagauaacuguugucaagugugauacaaaccaugucuugucuaacgacugugggaauuguaucucgaaaaccuugagcggucagaagauuuauacuccaguucaggauauguucugucagaaaggcuggacagaguccaucccaagcacaagguacucaaaagaccucuguucuauuggcuugcacacugugaaggaaugcaagacuggcaccaccaacuuugagagaguggguuucauuguuguggagagucgcaagauguacauagagcagaugaagaugagaucaaggcaagaauucagcgaagaccaguucuuaugcuacaaaucagagagcaguucuggcucuucuguaaaacuaaagaaggucaaaguugagucaugcaaagguguuacaacaucaucagccucuaagugcucuggggaugaauauuucugcagcagguacccaugugaaacugcaaauguugaagcccauugcauucuacgaaggcauagugcaguuauagaagugaaugucaauggcguauggguugugccgagaugcauugguuaugaagagguucuuguaagaaggacuucacucaaaguagaagauacaucuaguagagaaugugauaccugcuuaugggaaugcgggaaaaauaaacuaauugucaaaacucauggccccaaaauaguuuaugcaacagcauguagccaugggucuugcaagagugugaugcaaaagccagcgaccuucguguuucugccguacccaggaaacagcgagauuguuggaggugauauagggguccacaugacagaggaaucaucaccuucaaacauacacaugguggcacacugcccugcgaaggauuccugugagguuagcagcugccuauucugugugcacggacugcuuaauuaccagugccacaccuuguucucugcacuacuaauauccacuacugugauguccauucuuacauugcuacuucuucuugugaagggggcuaaagaucuugucaagagauuauucuacuggcuaauuacaccucugugcuggcuaucaguguucuguagcuggaugaucaaaagcuggagaaagagagugggcucagcuauuucuagaaccaaugacaccauugguuggcgugacaauagacgauaugggcaagacguugagagagcacaguacacaggaggagcuccagggacuaaauauucauuuuauggagugaugauucuuggccuauuagguaacgugcauaguugcucugagagugucauagccgacuccaaagucaugcaaugcacaacuucggggaguucuacccucugcaaggcuagugggacugugauuaugaagcuagggccuauaggcucagaguccugccugauuuugaagggucuuaaggacagugaaaagcaauucaucucaaucaagacaauaucaagugaacucacaugccgagagggagaguccuucuggacuacucuauauacuccugucugucuaaguucgcgaaggugccaccuaaugggagaaugugucuccgaccgcugccuuaaguggaaaacuaaugaaacaucugcagaauucacugggaaggcacauggagaaguuaugcaugagaauaaaugcuuugagcagagcgguggaauaggcuauggaugcuuuaaugugaacccuucuugucucuacguccauucuuaucucaaaucugucuacaagaacggauucaagaucuuuagauguguggcauggaaccauaggaucagacuugaaguuaccacucacuccaggaaguucccaaugguuuugauggcuaugagcacacaacccacugacugggguucuauuggguuaauccuagauucagaagggauaacagggacuaaugcguacuccuucaugaagcacgggucaggaagcuuugccauuauagaugacccauauucuccagagccucguaaaggcuuuuuaggagaagugcgauguccgacagaagagacagcuauucgggcgucacccucauguaagauggcuccuaacuugauugaguaccagcccgagauggacacugcagagugcacuacaaacaugauagaucccauggccauauucaaucgaggguccuugccacaaguccgggauggaaugacauuuacacaaucaauugagaagaacacaguucaagcacugacaacaggggagguuagagcuuccauacgccucacauuggacgacuaugacgugguguaucagaauagccagucugacugcucagcuacauuuaagaaucucaccggcuguuauucaugugaugagggcuccagaaugugcuaccaggugaaggcagaaggagaaacuaucuuucacuuugucaaugaggaugaauccaucaauguuauuaacaaggugagcccagacguaagugacuacugcacuguucuccacuucucaagaccugucaucucuauugaagggagguaugacugcgggcuuagcaaaagaccaaugguaauaaaagguacucuaauugcuacugccccgcaugaugauagaaagcaugaaggagguuccucauugguugucaaccccaaaggcggcacaguugacuucuucggaugggugucuggacuaaccucguggcuagguggaccucugaagaccuucuugaccauccuuggauuccuagcucugggccuacucuuaguaguggugaucaucaucauugcucguacuggggugcagcaggcccugaaaaagaaaaacaaguaa

SEQ ID NO: 4689 - RNA, 4020 nt, Artificial Sequence
  derived and/or modified CDS sequence (wt) from TOSV(TOSV/P51)__KU204979.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauuuuggacugaguuuauuaauguggcaaagccauugagugaaauagucccaaugucagugauuccaccaccaguugugaagcuccagccaccugcagaaccauccuccaagaaacauguuccguuugauguacuuuugucagaagcugagaaggagcuaaaccagacaaaaauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagauaggaaggcccaugagcuugauagaaugcuuaaaaagaaggagcgcgaaagccugauugcaaaagagaaagcagaugagaacaugagaagccaugugcaugaaccaaacacgacuagagccccagcacccacaauuaucaccacucugcucauggcaagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugguuaagugugaaacaaaccacguccuuucuagugauuguggaaauugcaucucuaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguauccaugugaaacagccaacguugaagcccacugcauucuaaggaggcacagugcaauaguggaagugaaugucaacggcguguggguugugccuagguguauuggcuaugaggagguucuggucaaaaggacaucacucaagguugaagauacgacagggagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccuaccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguucuacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgaugccucaaguggaagacuaaucaaacauccgcagaauucacagggaaagcacauggugacgucaugcacgagaacagaugcuuugagcaaaguggaggaauaggcuacggauguuuuaacguaaacccuucuugucucuauguccacucuuaucucaagucuguuuacaggaacggguucaaaguuuucagguguguggcauggaaucauaggauuagacuagaggugacgacacacucccgaaaguucccuaugguuuugauggccaugagcacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugguugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucacauuagaugauuaugaugugguguaucaaaauagccagucugacugcucagccacauuuaagaaccucacugguuguuacucaugugaugaaggauccagacuaugcuaucaagugaaggcagaaggcgagacuauuuuucacuuuauuaaugaagaagaguccaucaaugucaucaauaagguaagcccgagagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4690 - RNA, 4020 nt, Artificial Sequence
  derived and/or modified CDS sequence (wt) from TOSV(TOSV_Italy/BB8/2014/human)__KY626661.1__GP
auguuuauugcaaaguuguuauuaauuuccuguuuagugcagcaggccuaucugaaauacacuauuauuucagaaauagggaacggcacuagaacuucuuuuuguuauagcucaagaacuaguuuggggagccuccuggaagcuugggacaauauaacugagucuauuggucugacgucuggcacuuguaaaguaggaucacuggagaacagggauugcaaaagagacaucaugucaaauuauguugcagaagugcauuccaacuuacauggccuaggagcuaugaugcacaacuauggugaugacaagaggguugagguccucaaugaugucaucccagaugagcucaauccaggacgucacaacugcagugaccuagaccggaagccauuuuggacagaguucauugauguggcgaagccaacgaacaaaauagcuccuaugucagugaucccaccaccaauugugaaacccauaccaguugcagaaucaaccauuaagaaaagcaucccauuugauaaacucuuaucugaagcagaaaaggaguugaaccaaacuaaaaucagauuggaaaccgaaagaaggucuaaugcagaagaagcugcaaaagaaagggccaggaugagggaaauugaagacaagcugagaaaggacugggagcuagaacgggagagaaaagaugcaguggcagacgaccuggcaaaagaaauagcgagaagaagagagauagagagaaaagcucaugaauuagauaagaugcucaagaagaaggagcgugaagaucugguggcaagagaaagggugagugaggauaugagaaaccauguguguaaaccaaauacaaccauagccccugcucccacaauuauuacuacccugcucauggccagugcaguaauggcaggaccuuuggagaacagggaaacaaaccacuuacuaaacaggccagggaauggagcuuacacccuaagugacuuugcugaguccaccugcacgcuagcuuauggcucagagugcaaauccugggagcaccaacuggaugagcugucuuuucccuucuuccacucuaaccuugacaaguacagcaugcuggaggcugcaacagagacaauaccgauacucaacaagagcucagcugucugcacaauuuccccauccacgcacucaucaaaugcaugugguagggaagccagccucauaaagaagaaauguggaagcaauaugucagcuuucuuuuauguuaaccuagccggucagauaacuguugucaagugugauacaaaccaugucuugucuaacgacugugggaauuguaucucaaaaaccuugagcggccagaagauuuauacuccaguucaggauauguucugucagaaggguuggacagaguccaucccaaacacaagguacucaaaagaccucuguucuauuggccugcauucugugaaagaaugcaagacugguaccaccaacuuugagagaguggguuucauuguugugaagggucggaagauguacauugagcagaugaagaugagaucgaggcaagaauucagcgaagaccaguucuuaugcuacaaaucagagagcaguuccggcucuucugugaaacuaaagaagguuaagguugagucaugcaaaggugucacaacaucaucagccucuaagugcucuggggaugaauauuucugcagcagguacccaugugaaacugcaaauguugaggcccacugcauucuucgaaggcauagugcaguuauagaagugaaugucaaugguguauggauugugccgagaugcauugguuaugaagagguucuuguuagaaggacuucauuaaaaguugaagauacaucuaguagagaaugugauaccugcuuaugggaaugcgggaaagauaaacuaauugucaaaacucauggcccuaaaauaguuuaugcaacagcauguagccaugggucuugcaagagugugaugcaaaagccagcaaccuucguguacuugccguacccaggaaacagcgagauuguuggaggugauauagggguccacaugacagaggaaucaucaccuucaaacauacacaugguggcacacugcccugcgaaggauucuugugagguuagcagcugccuauucugugugcacggacugcuuaauuaccagugccacaccuuguucucugcauuacuaauauccaccacugugauguccauucuuacacugcuacuucuucuuaugaagggagcuaaagaucuugucaagagauuguucuacuggcuaaucacaccccugugcuggcuaucaguguucuguggcugggugaucaaaagcuggaaaaagagagugggcucagcuauuucuaggaccaaugacaccaucgguuggcgagacaauagacgauacaggcaagacgucgagagagcacaguacacaggaggagcuccaggggcuaaauacucauuuuauggaguaaugguccuuggccuauuagguaaugugcauaguugcucugagagugucauagcugacuccaaaaucaugcaaugcacaacuucgggaaguucuacccucugcaaggcuagugggacuguaauuaugaagcuagggccuauaggcucagaguccugccugauuuugaagggucucaaggauagugagaaacaauucaucucaaucaagaccauaucaagugaacucacaugccgagagggagaguccuucuggacuacucuauauacuccugucugucuaagcucgcgaaggugccaccugaugggagaaugugucuccgaccgcugccucaaauggaaaaccaaugaaacaucugcagaauucacugggaaggcacauggagagguuaugcaugagaauaggugcuuugagcagagcgguggaauaggcuacggauguuuuaaugugaacccuucuugucucuacguccauuccuaucucaaaucugucuacaagaauggauuuaagaccuuuagauguguggcauggaaccauaggauuagacuugaaguuacuacccacucccggaaauucccaaugguuuugauggcuaugagcacacaaccgacugacugggguucuauuggguuaauccuagauucagaagggauaacagggacuaacgcguauuccuuuaugaggcacgggucaggaagcuuugccaucauagacgacccauauuccccagagccucguaaaggcuuucuaggagaagugcgauguccaacagaagaaacagcuauucgggcgucacccucauguaagauggccccuaacuugaucgaauaccagccugagauggacacugcagagugcacuacaaacaugauagaccccauggccauauucaaucgaggguccuugccacaaguccgagauggaaugacauucacacaaucaauugagaagaacacaguucaagcacugacaacaggggaaguuagagcuuccauacgccucacauuggacgacuaugaugugguguaccaaaauagccaguccgacuguucagcuacauuuaagaaucucaccggcuguuauucaugugaugaggguuccagaaugugcuaccaggugaaggcagaaggagaaacuaucuuucacuuuaucaaugaggaugaauccaucaaugucauuagcaagguaaacccagacguaagugacuacugcacuguucuccacuucucaagaccugucaucucuauugaagggagguaugacugcgggcuuagcaaaagaccaaugguaauaaaagguacucuaauugcuacugccccgcaugaugacagaaagcaugaaggaggcuccucauugauugucaaccccaaaggcggcacaguugauuucuucggaugggugucuggacuaaccucauggcuagguggaccucugaaaaccuuccugaccauccuuggauuccuagcucugggccuacuuuuaguagugauaaucaucaucauugcucgcacuggggugcaacaggcccuaaaaaagaaaaacaaguaa

SEQ ID NO: 4691 - RNA, 4020 nt, Artificial Sequence
  derived and/or modified CDS sequence (wt) from TOSV(TOSV-54441132704)__KX010933.1__GP
auguuuauugcaaaguuguuauuaauuuccuguuuagugcagcaggccuaucugaaauauacuauuauuucagagauagggaacggcacuagaacuuccuuuugcuacaguucaagaacuagcuuggggagccucuuagaagcuugggacaacgugacugagucaauuggccugacuucuggcacuugcaaaguggggucacuggagaacagggacugcaggaaagacauaauguccaacuacguugcugaggugcacucuaaccugcacgggcugggagcuaugaugcacaacuacggugaugacaagaggguugagauccucaaugaugucauaccagaugagcucaauccuggacaccacaacuguagugaccuugaccgaaagccauucuggacugaguuuauuaauguggcaaagccauugagugaaauagucccaaugucagugauuccaccaccaguugugaagcuccagccaccugcagaaccauccuccaagaaacauguuccguuugauguacuuuugucagaagcugagaaggagcuaaaccagacaaagauuagacuggaagaugagagaaaguccaaugcagaagagacagcaaaggagagggcuaggaugaaggagauugaggaugaauugagaagggagugggagcuggaacggaagaggaaggacgcaauggcagaugauuuagcaaaagaaacagcaagaaggagggagauagaaaggaaggcccaugagcuugauaaaaugcuuaaaaagaaggagcgcaaaagccugauugcaaaagagaaagcagauguggacaugagaagccaugugcauaaaccaaacacgacuagagccccagcacccacaauuaucaccacucugcucauggcgagugcagcccuagcgggaccccuggagaacagggagacaaaucauuugcucaacaggccaggaaauggggcuuacacucuaagcgacuuugcugaaucaaccugcacacuggccuauggaucagaaugcaaaucuugggagcaccuucugaaugaggagcuguuccccuucuuccauucuaaucuugacaaguacagcaugcuagaagcugcaacagagacaguaccuauacucaauaagagcucugcaguuugcaccauuucuccuuccacacauucaucgaaugccugugggagagaggcuagugucauuaggaagaaauguuauaguaacaugucagccuucuucuacauuaaccuggcaggucaaauuacugugauuaagugugaaacaaaccacguccuuucuagugauuguggaaauugcaucuccaagagcuugaguggccaaaagguauacaccccagugcaagauguguucugucagaagggcuggacacaguccaucccaagcacaagauauucaaaagacaucuguucuauugguuugcacaccgugaaggaaugcaagauaggaaccacuagcuuugagaggguggguuucauaguugugaaaggccgcaagauguacauugagcagaugaagaugagaucaaggcaggaauacagcgaagaucaauuuuugugcuauaaaucagaaagcggcucuggcucaucugucaagcuaaagaaguucaagguugaaucaugcaaggguguuacuacaucaucagccucuaagugcucuggcgaugaguauuucugcagcagguauccaugugaaacagccaacguugaagcccacugcauucuaaggaggcauagugcaauaguggaagugaaugucaacggcguguggguugugccuagguguauuggcuaugaggagguucuggucaaaaggacaucacucaagguugaagauacgacaggaagggaaugugauuccugcuuaugggaaugugggaagaauaagcugauugucaagacucauggucccaaagugguuuaugcaacagcaugcagccauggauccuguaaaagugugaugcagaagccagcaaccuuuguguaccugccauacccuggaaauagugaaauuguugggggugacauagggauucacaugacagaagagucaucacccucgaauauacacuuaguagcacacugcccugcaagggacucaugugaugucagugacugucuauucugcguucacggacuccuuaauuaucagugccacaccuuguuuucagcauugcucauaucaacuacugugaugucaauucucacauugcugcucuugcuugugaaaggggcaaaggaucuuguuaagaaauuguucuacuggcugaucacuccuuuaugcuggcuaucagucuuuugcugcugggugguuaaaagcuggaaaagaagaguggguucagcaauuucuaggacaaacgacacuauugguuggcgugaaaacaggcggcaugcucaagacauugagagagcacaguacacaggaggggcuccaggggccaaauauucauuuuaugggguuaugauucuaggauuacugaguagugcccagaguugcucugaaagugugauagcagacuccaagaucaugcaaugcacaaccucagggaguuccacccuuugcaaggcaagcgggacaguaaucaugagauugggacccauaggcucagagucuuguuugauucugaaagggcucaaggacagugaaaagcaguucauaucuaucaagaccauaucaagugaacucacgugccgagaaggagaaucuuucuggaccacccuauacacaccuaucugcuuaagcucaagaagaugucacuugaugggagaaugugucucugaucgcugccucaaguggaagacuaaucaaacauccgcagaauucacaggaaaagcacauggugacguuaugcacgagaacagaugcuuugagcaaaguggaggaauaggcuacggauguuuuaacguaaacccuucuugucucuauguccacucuuaucucaagucuguuuacaggaacggguucaagguuuucagguguguggcauggaaucauaggauuagacuagaggugacgacacacucccgaaaguucccuaugguuuugauggccaugaguacacagcccacugacuggggauccauugguuugauucuugacucagaagggauaacaggaacaaauucuuauuccuuuaugaaacauggcucaggaaguuuugcuauaauagaugacccauauucuccagagccucgaaaaggguuccugggagaagugcgguguccuacagaagagacagccaugcgagcaucaccuucuugcaagauggcuccaaacuugauugaguaucagccugaaauggacacagcagaguguaccacaaauaugauagacccuauggcuauauucaaucgaggaucucugccacagguucgggaugggaugacuuucacgcaaucaauagaaaagaacacuguucaggcauuaacaacaggggaaguuaaggcauccauccgccucauauuagaugauuaugaugugguguaucaaaauagccagucugacugcucagccacauucaagaaccucacugguuguuacucaugugaugaaggauccagacuaugcuaucaagugaaggcagaaggcgagacuauuuuucacuuuaucaaugaagaagaguccaucaaugucaucaauaagguaagcccgggagugagcgacuacugcaccguucuccauuucucaaggccuguuauuucuauugagggaacauaugacugcgggcuaagcaagagaccaauggugauaaaagguacucuaauugccacugcuccacaugaugauagaaagcaugaaggagguucuucuuuaguagucaaccccaaaggugguucaguugacuucuuuggaugguugucuggauugaccucauggcucggagguccucucaaaacauuucugacuauucuuggauuccuagcugugggcuuacuguugguggugauaauuaucaucaucauucggacuggaaugcaacaagcuuugaagaagaagauaaaauaa

SEQ ID NO: 4692 - RNA, 3222 nt, Artificial Sequence
  derived and/or modified CDS sequence (wt) from SFTSV(HB29)__NC_018138.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4693 - RNA, 3222 nt, Artificial Sequence
  derived and/or modified CDS sequence (wt) from SFTSV(Jilin)__KT890281.1__GP
augaugaaagucaucugguucuccucucugaucugcuuagucauucaaugcgguggggauacgggcccaaucaucugugcaggacccauccacucaaacaagagugcuaacauaccccaccugcuuggcuacucugagaagauuugucagauagaucggcugauacauguuucgucauggcucagaaaccacucacaauuucagggcuacguagggcagcgagguggacgcucucaggugagcuacuacccggcugaaaauucuuacucaagguggaguggacuucuaagccccugugaugcugauuggcuugggaugcuugucgugaagaaggccaaggggucugauaugauaguuccugggcccucauacaaggggaaagucuuuuuugaacggccaacuuuugauggauacguaggcuggggcugugguagugggaagucuaggacugagucaggugagcucugcaguucagacuccgggacuagcucuggucuucugcccucggauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcguggauggauguuggccacucucauaaaaucaucaugagggagcacaagaccaaguggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaaaugcuaugguuucuccagaaugauggcaccacuggaggugaacccaccagagcaaaggauuggucaauguacuggcugccaucuagaaugcauaaaugggggugugaggcuaaucacuuuaaccagugagcucaagucagcuacugucugcgcuuaucacuuuuguaguugugccacaagugguaagaaaagcacggagauucaauuccacucaggaucauugguuggaaaaacagcaauccacgucaaaggggcauugguagauggaacugaauucacauuugaggguagaugcauguucccagaugguugugaugcaguggacugcacauucugucgugaguuucuaaaaaauccucagugcuacccugcacagaaguggcuguucaucauuauugucauccuccuaggauaugcaggccucaugcuacucaccaauguucuuaaggcaauggggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggaucgagauggccagacccaggaggguaaggcauuggauguacucaccugucauccagacuauuguagcaauagggcuugcugagggcugugaugagaugguccaugcugauucuaaacuuguuucgugcaggcaggggagcggaaauaugaaggaaugugucacaacugggagggcgcuucuuccugcggugaacccaggucaagaggcgugucugcacuucacggcaccugggaguccggacucaaaaugucucaaaauuaggguuaagaggaucaaccuaaaauguaagaagucaucaucauauuuuguuccugaugcccgguccagauguacaucagugaggagaugucguugggcuggagacugccagucugggugccccccucauuucacauccaauuccuuuucugaugauugggcagguaagauggacagggcuggucuaggauucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugagaacauuccaccccaugaguggcauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccgcaccauaaaaaaagaugggugcauauggaaugcagaccucguggguauagagcuacgaguggaugacgcuguguguuacuccaagaucacuaguguggaggcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4694 - RNA, 3222 nt, Artificial Sequence
  derived and/or modified CDS sequence (wt) from SFTSV(05-Lu'an(CHN)-2015)__KX302597.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucuggagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcaguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauguuugccaucauaaagaaacuaaugagaacugugagcuacuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuucaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4695 - RNA, 3222 nt, Artificial Sequence
  derived and/or modified CDS sequence (wt) from SFTSV(07-Lu'an(CHN)-2015)__KX302598.1__GP
augaugaaagucaucugguucuccucucugaucugcuuagucauucaaugcaguggggacucggguccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccuccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccagaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguaguugaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4696 - RNA, 3222 nt, Artificial Sequence
  derived and/or modified CDS sequence (wt) from SFTSV(12-Lu'an(CHN)-2014)__KX302595.1__GP
augaugaaagucaucugguucuccucucugaucugcuuagucauucaaugcaguggggauacaggcccaaucauaugcgcagggcccauccacucgaacaagagugccaacauaccccaccugcuugguuacucugagaagauuugucagauagaucggcugauacauguuucgucauggcugagaaaccauucacaauuucagggcuacguggggcagcgagguggucgcucucaggugaguuacuacccagcugaaaacucuuacucaagguggaguggacuucuaagccccugugaugcugauuggcuugggaugcuugucgugaagaaggccaaggggucugauaugauaguuccugggccuucauacaaggggaaggucuuuuuugaacggccaacuuuugauggauacgugggcuggggcuguggcagugggaagucaaggacugagucaggugaacucugcagcucagacucagggaccaguucuggucuucugccgucagauaggguucucuggauaggugauguggcuugucagcccaugacacccaucccugaggagacauuuuuggagcugaagaguuuuagccagagugaauucccagacauaugcaaaguugauggcauuguguucaaccagugugauagugagagucuaccucagcccauugaugucgcauggauggauguaggucacucucauaagaucaucaugagggagcacaagaccaaauggguacaagagagcucaucaaaagauuuugugugcuacaaggaagggacugggccauguucugaaucggaagaaaagacuuguaagaccaguggaucaugcaggggggacaugcaguuuugcaagguggcagguugugaacauggggaagaggcaucugaagccaaguguagaugcucacuagugcauaagcccggggaaguuguuguaucauauggagggaugcgugucagaccaaaguguuaugguuuuuccagaaugauggcaacacuagaggugaacccuccagagcaaagaauuggccaaugcacuggcugccaucuagaaugcauaaaugggggugugaggcuaaucacucuaacuagcgagcucaagucagcuacugucugugcuucccacuuuuguaguucugccacaaguggcaagaaaagcacggagauucaauuccacucagggucauugguugggaaagcagcaauacacgucaaaggggcuuugguggauggaacugaauucacauuugagggcaguugcauguucccagaugguugugacgcaguggacugcacauucugucgugaguuucuaaaaaauccgcagugcuacccugcaaagaaaugguuguucauuauuauugucauccuccuuggauaugcaggccucaugcuacucaccaauguccuuaaggcaaucgggguuuggggaucaugggucauggcuccagugaagcuaauguuugccaucaugaagaaacugaugagaucugugagcugcuugaugggaaaauugauggauaggggaaggcaagugauccaugaagaaauaggggagaauagagagggcaaccaagaugauguuaggaucgagauggcaagacccagaagggugaggcauuggauguacucaccugucauccugacuauucuagcaauugggcuugcugagggcugcgaugagaugguccaugcagauucuaaacuuguuucgugcagacaagggagcggaaauaugaaggaaugugucacaacugggagggcacuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugucagucugguugccccucuuauuucacguccaacuccuucucugaugauugggcagguaaaauggacagggcuggucuaggauucaguggcugcucugauggauguggaggagcagccugcggcugcuuuaaugcggccccuucaugcaucuucuggaggaaauggguagagaauccacaugggaucaucuggaaaguauccccaugugcugcaugggucccuucagcagucauagagcugacaaugcccucgggggaagugaggacauuccaccccaugagcggcauccccacacaagucuucaagggugugagugugacuuacuuaggcucagauauggaggugucuggcuugacugaccugugugagauagaagagcucaaguccaagaagcuggcauuggcucccugcaaucaggcuggcauggggguaguaggcaagguuggagagauacaguguagcagcgaggaaagugcccguaccauaaagaaagauggguguauauggaaugcugaccuugugggcauagagcuacgaguggaugacgcugugugcuacucuaagaucacuaguguggaggcaguugcaaacuacucugccauacccaccacuauuggagggcuaagguuugagagaagccaugacagccaggguaaaauaucugguagcccccuagacaucacagccauaagagggucuuuuucgguuaauuauagaggccuucgacugagccucucagaaauuacugcuacuugcacaggagaggugacgaaugugaguggguguuacucuugcaugacaggcgccaaagucuccaucaaacugcauagcagcaaaaauagcacugcccauguaagaugcagaggggaugagacugcguucaguguccuggaaggaguucauagcuauacugucagucucagcuuugaccaugcaguggucgaugagcagugccagcugaacuguggggggcaugagagucaagugacucuaaaaggcaaccucaucuuccuggaugucccaaaauuuguagauggcagcuauaugcagacauaucauaguucugugcccacaggggcuaauaucccaagcccuacagacuggcugaaugccuuguuuggcaaugggcugaguagguggauucugggggugauagggguucuacuggggguauuggcucucuucuucuuaaucaugucuuuguucaaacugggaacaaaacagguaauucgaucaaggacgaagcuggcuuag

SEQ ID NO: 4697 - RNA, 3222 nt, Artificial Sequence
  derived and/or modified CDS sequence (wt) from SFTSV(14-Lu'an(CHN)-2014)__KX302596.1__GP
augaugaaagucaucugguucuccucucugaucugcuuagucauucaaugcaguggggauacaggcccaaucauaugcgcagggcccauccacucgaacaagagugccaacauaccccaccugcuugguuacucugagaagauuugucagauugaucggcugauacauguuucgucauggcugagaaaccauucacaauuucagggcuacguggggcagcgagguggucgcucucaggugaguuacuacccagcugaaaacucuuacucaagguggaguggacuucuaagccccugugaugcugauuggcuugggaugcuugucgugaagaaggccaaggggucugauaugauaguuccugggccuucauacaaggggaaggucuuuuuugaacggccaacuuuugauggauacgugggcuggggcuguggcagugggaagucaaggacugagucaggugaacucugcagcucagacucagggaccaguucuggucuucugccgucagauaggguucucuggauaggugauguggcuugucagcccaugacacccaucccugaggagacauuuuuggagcugaagaguuuuagccagagugaauucccagacauaugcaaaguugauggcauuguguucaaccagugugauagugagagucuaccucagcccauugaugucgcauggauggauguaggucacucucauaagaucaucaugagggagcacaagaccaaauggguacaagagagcucaucaaaagauuuugugugcuacaaggaagggacugggccauguucugaaucggaagaaaagacuuguaagaccaguggaucaugcaggggggacaugcaguuuugcaagguggcagguugugaacauggggaagaggcaucugaagccaaguguagaugcucacuagugcauaagcccggggaaguuguuguaucauauggagggaugcgugucagaccaaaguguuaugguuuuuccagaaugauggcaacacuagaggugaacccuccagagcaaagaauuggccaaugcaccggcugccaucuagaaugcauaaaugggggugugaggcuaaucacucuaacuagcgagcucaagucagcuacugucugugcuucccacuuuuguaguucugccacaaguggcaagaaaagcacggagauucaauuccacucagggucauugguugggaaagcagcaauacacgucaaaggggcuuugguggauggaacugaauucacauuugagggcaguugcauguucccagaugguugugacgcaguggacugcacauucugucgugaguuucuaaaaaauccgcagugcuacccugcaaagaaaugguuguucauuauuauugucauccuccuuggauaugcaggccucaugcuacucaccaauguccuuaaggcaaucgggguuuggggaucaugggucauggcuccagugaagcuaauguuugccaucaugaagaaacugaugagaucugugagcugcuugaugggaaaauugauggauaggggaaggcaagugauccaugaagaaauaggggagaauagagagggcaaccaagaugauguuaggaucgagauggcaagacccagaagggugaggcauuggauguacucaccugucauccugacuauucuagcaauugggcuugcugagggcugcgaugagaugguccaugcagauucuaaacuuguuucgugcagacaagggagcggaaauaugaaggaaugugucacaacugggagggcacuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccuucagcagucauagagcugacaaugcccucgggggaagugaggacauuccaccccaugagcggcauccccacacaagucuucaagggugugagugugacuuacuuaggcucagauauggaggugucuggcuugacugaccugugugagauagaagagcucaaguccaagaagcuggcauuggcucccugcaaucaggcuggcauggggguaguaggcaagguuggagagauacaguguagcagcgaggaaagugcccguaccauaaagaaagauggguguauauggaaugcugaccuugugggcauagagcuacgaguggaugacgcugugugcuacucuaagaucacuaguguggaggcaguugcaaacuacucugccauacccaccacuauuggagggcuaagguuugagagaagccaugacagccaggguaaaauaucugguagcccccuagacaucacagccauaagagggucuuuuucgguuaauuauagaggccuucgacugagccucucagaaauuacugcuacuugcacaggagaggugacgaaugugaguggguguuacucuugcaugacaggcgccaaagucuccaucaaacugcauagcagcaaaaauagcacugcccauguaagaugcagaggggaugagacugcguucaguguccuggaaggaguucauagcuauacugucagucucagcuuugaccaugcaguggucgaugagcagugccagcugaacuguggggggcaugagagucaagugacucuaaaaggcaaccucaucuuccuggaugucccaaaauuuguagauggcagcuauaugcagacauaucauaguucugugcccacaggggcuaauaucccaagcccuacagacuggcugaaugccuuguuuggcaaugggcugaguagguggauucugggggugauagggguucuacuggggguauuggcucucuucuucuuaaucaugucuuuguucaaacugggaacaaaacagguauuucgaucaaggacgaagcuggcuuag

SEQ ID NO: 4698 - RNA, 3222 nt, Artificial Sequence
  derived and/or modified CDS sequence (wt) from SFTSV(18-Lu'an(CHN)-2015)__KX302599.1__GP
augaugaaagucaucugguucuucucucugaucugcuuugucauucaaugcaguggggauucaggcccaaucaucugcgcaggacccauccacucaaacaagagugcugacauaccucaccugcuggguuauucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucugagccccugugaugcugauuggcuugggaugcuugucgugaagaaggccaaggggucugauaugauagucccugggccuucauacaagggaaaagucuuuuuugaacggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucauguaggggagacaugcaguucugcaagguggcagguugugaacauggggaagaggcaucugaagccaagugcagaugcucacuugugcacaagcccggagaagucguugugucauauagagggaugcguaucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgagcggcaagaaaagcacggagauucaauuccacucaggaucauugguugggaaaacagcaauacacgucaaaggggcauugguggauggaacugaauucacauuugaggguaguugcauguucccagaugguugugaugcgguggacugcacuuucugucgugaguuucuaaaaaauccccagugcuacccugcuaagaaauggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggaucgagauggcaagacccagaaggguaaggcauuggauguacucaccugucauccugaccauuuuagcaauagggcuugcugagggcugugaugagaugguccaugcugauucuaagcuuguuucaugcaggcaagggagcggaaaugugaaggaaugugucacaacugggagggcgcuucuuccugcggugaacccaggucaagaggcgugucugcacuucacggcaccugggaguccggacucaaaaugucucaaaauuaggguuaagaggaucaaccuaaaauguaagaagucaucaucauauuuugucccugaugcccgguccagauguacaucagugaggagaugucguugggcuggagacugccagucugggugccccccucauuucacauccaauuccuuuucugaugauugggcagguaagauggacagggcuggucuaggauucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugagaacauuccaccccaugaguggcauccccacacaagucuucaagggugugagcauaacuuacuugggcucagauauggaggugucuggcuugacugaccuaugugagauagaggagcucaagucuaagaagcuggcauuagcucccugcaaccaggcuggcauggggguuguaggcaagguuggagagauacagugcaguagcgaggaaagugcccguaccauaaaaaaagaugggugcauauggaaugcagaccucgugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagccauaagagggucuuuuucuguuaauuauagaggccuucgacugagucucucagaaauuacugcaaccugcacaggggaggugacaaaugugaguggguguuauucuugcaugacaggcgccaaagucucuaucaaacugcauagcaacaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucacagcacugugcccacaggggcaaauaucccaagcccuacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacgaagcuggcuuag

SEQ ID NO: 4699 - RNA, 3222 nt, Artificial Sequence
  derived and/or modified CDS sequence (wt) from SFTSV(27-Lu'an(CHN)-2015)__KX302600.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugccaucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcguaucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaauguguaacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauacuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaauguaaguggauguuauucuugcaugacaggcgccaaagucucuaucaaacuacauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4700 - RNA, 3222 nt, Artificial Sequence
  derived and/or modified CDS sequence (wt) from SFTSV(36-Lu'an(CHN)-2015)__KX302601.1__GP
augaugaaagucaucugguucuccucucugaucuguuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucaggaacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucguccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4701 - RNA, 3222 nt, Artificial Sequence
  derived and/or modified CDS sequence (wt) from SFTSV(42-Lu'an(CHN)-2015)__KX302602.1__GP
augaugaaagucaucugguucuccucucugaucugcuuugucauucaaugcaguggggacucaggcccaaucaucugcgcaggacccauccacucaaacaagagugcugacauaccucaucugcuggguuucuccgagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucaaccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggaaggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagcuccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguuucaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaagcuacauagcagcaaaaauagcacugcccauguaagaugcaaaggggaugagacugcauucagugucuuggaggggguucauagcuacacugucagucucaguuuugaccaugcuguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4702 - RNA, 3222 nt, Artificial Sequence
  derived and/or modified CDS sequence (wt) from SFTSV(44-Lu'an(CHN)-2015)__KX302603.1__GP
augaugaaagucaucugguucuccucucugaucugcuuugucauucaaugcaguggggacucaggcccaaucaucugcgcaggacccauccacucaaacaagagugcugacauaccucaucugcuggguuucuccgagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucaaccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagcuccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguuucaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaagcuacauagcagcaaaaauagcacugcccauguaagaugcaaaggggaugagacugcauucagugucuuggaggggguucauagcuacacugucagucucaguuuugaccaugcuguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4703 - RNA, 3222 nt, Artificial Sequence
  derived and/or modified CDS sequence (wt) from SFTSV(52-Lu'an(CHN)-2015)__KX302604.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacguucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucugggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugagcauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacagagauucaauuccacucagggucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaggucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4704 - RNA, 3222 nt, Artificial Sequence
  derived and/or modified CDS sequence (wt) from SFTSV(HL/Injected)__KF791953.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaaaagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuggcaauagggcuugcugagggcugugaugagaugguccaugcugauucuaaacuuguuucgugcaggcaggggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4705 - RNA, 3222 nt, Artificial Sequence
  derived and/or modified CDS sequence (wt) from SFTSV(HL/Larvae/G2)__KF791955.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccaggacuaguucuggucuucugcccucggauaggguucucuggauaggugauguugcuugucagccaaugacacccaucccugaggagacauuucuggagcugaaaagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuggcaauagggcuugcugagggcugugaugagaugguccaugcugauucuaaacuuguuucgugcaggcaggggagcggaaacaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4706 - RNA, 3222 nt, Artificial Sequence
  derived and/or modified CDS sequence (wt) from SFTSV(JS2011-004)__KC505124.1__GP
augaugaaagucaucugguucuccucucugaucugcuuagucauucaaugugguggggauacaggcccaaucaucugcgcaggacccauccacucaaacaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcuguggcagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugggggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuuggggaucaugggucauagcuccagugaagcuaguguuugccaucaugaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucgugggcauagagcuacgaguggaugacgcuguguguuacucuaagaucacuaguguggaggcaguugcaaacuacucugcuauacccaccacuauuggggggcugagguuugagagaagccaugacagccaggguaaaauaucugguagcccccuggacaucacagcuauaagaggaucuuuuucugucaauuauagaggccuucgacugagucucucagaaauuacagcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacuguggggggcaugagagucauguuacucugaaagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggugugauagggguccuacuggggggauuggcucucuuuuucuugaucaugucuuuguucaagcugggaacaaaacagguauuucgaucgaggacgaagcuggcuuag

SEQ ID NO: 4707 - RNA, 3222 nt, Artificial Sequence
  derived and/or modified CDS sequence (wt) from SFTSV(JS2011-013-1)__KC505127.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaagccaaggggucugauaugauaguuccugggccuucauacaaggggaaagucuuuuuugagcggccaacuuuugauggauauguaggcuggggcugugguagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacauggaaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcuguguguuacucuaaaaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaaauauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggagggaggucauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4708 - RNA, 3222 nt, Artificial Sequence
  derived and/or modified CDS sequence (wt) from SFTSV(JS2011-027)__KC505130.1__GP
augaugaaagucaucugguucuccucucugaucugcuuagucauucaaugcgguggggauacaggcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgaucucaggugagcuacuacccagcugaaaauucuuacucaagguggaguggacuucuaagccccugugaugcugauuggcuugggaugcuugucgugaagaaggccaaggggucugacaugauaguuccagggccuucauacaaggggaaagucuuuuuugaacggccaacuuuugauggauacguaggcuggggcuguggcagugggaagucuaggacugagucaggugagcucugcaguucagacuccgggacuaguucuggucuucugcccucagauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacuggaccuuguucugaaucagaagaaaagacuugcaagaccaguggaucaugcaggggggacaugcaguuuugcaagguggcagguugugaacauggggaagaggcaucugaagccaagugcagaugcucacuugugcacaagcccggggaagucguugugucauauggagggaugcgugucagaccaaagugcuaugguuucuccagaaugauggcaacacuggaggugaacgaaccagagcagaggauuggucaaugcacuggcugccaucuagaaugcauaagugggggugugaggcuaaucacucuaaccagugagcucaagucagcuacugucugcgcuucucacuucuguaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuuggggaucaugggucauagcuccagugaagcuaguguuugccaucauaaagaaacuaaugagagcugugagcugccugauggggaaauugauggauagaggaaggcaagugauccaugaggaaauaggggagaauagagagggcaaccaagaugauguuaggauugagauggccagacccaggaggguaaggcauuggauguacucgccugucauccugacuauucuagcaauggggcuugcugagggcugugaugagaugguccaugcugauucuaaacuuguuucgugcaggcaagggagcggaaauaugaaggaaugugucacaacugggagggcgcuucuuccugcagugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugugguugcuuuaaugcggccccuucuugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcuuuagcucccugcaaccaggcugguauggggguuguaggcaagguuggagagauacagugcaguagcgaggaaagugcccguaccauaaaaaaagaugggugcauauggaaugcagaccuuguggguauagagcuacggguggaugacgcugugugcuacucuaagaucacuaguguggaggcaguugcaaacuacuccgccauacccaccacuauuggggggcugagguuugagagaagccaugacagccagggcaaaauaucugguagcccccuggacaucacagcuauaagaggaucuuuuucuaucaauuauagaggccuucgacugagccucucagaaauuacugcuacuugcacaggggaagugacaaaugugaguggguguuauucuugcaugacaggcgccaaagucuccaucaaguugcauagcagcaaaaauagcacugcccauguaagaugcaaaggggaugagacugcauucagugucuuggagggaguccauagcuacucugucagucucaguuuugaucaugcaguaguugaugagcagugccaacugaacugugggggacaugagagccaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauccugggggugauagggguccuacuggggggauuggcucucuuuuucuugaucaugucuuuguucaagcugggaacaaaacagguauuucgaucgaggacgaagcuggcuuaa

SEQ ID NO: 4709 - RNA, 3222 nt, Artificial Sequence
  derived and/or modified CDS sequence (wt) from SFTSV(JS2011-034)__KC505133.1__GP
augaugaaagucaucugguucuccucucugaucugcuuugucauucaaugcaguggggacucgggcccaaucaucugugcaggacccauccacucaaauaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauagucccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucuguaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauuggaauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguugcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugcuauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuugcucaagcugggaacaaaacagguauaucgaucaaggacaaagcuggcuuag

SEQ ID NO: 4710 - RNA, 3222 nt, Artificial Sequence
  derived and/or modified CDS sequence (wt) from SFTSV(JS2011-062)__KC505136.1__GP
augaugaaagucaucugguucuccucucugaucugcuuagucauucaaugcaguggggacucgggcccaaucaucugcgcaggacccauccacucaaacaagagugcugacauaccucaccugcuugguuacucugagaagauuugucagauagaucggcugauacauguuucgucauggcucaggaaccacucgcaauuucagggcuauguaggacagcgagguggacgcucucaggugagcuacuacccagcugugaauucuuacucaagguggaguggacuucuaagccccugugaugcugauuggcuugggaugcuugucgugaagaaagccaaggggucugauaugauaguuccugggccuucguacaaggggaaagucuuuuuugaacggccaacuuuugauggauauguaggcuggggcuguggcagugggaagucuaggacugagucaggagagcucugcaguucagacucagggacuaguucuggucuucugcccucgaauaggguucucuggauaggugauguugcuugucagccuaugacacccaucccagaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaagauuuugugugcuauaaggaagggacugggccuuguucugaaucagaagaaaaggcuugcaagaccaguggaucaugcaggggggacaugcaguuuugcaagguggcagguugugaacauggggaggaggcaucugaagccaaguguagaugcucacuugugcacaaacccggggaagucguagugucauauggagggaugcgugucagaccaaagugcuaugguuucuccagaaugauggcaacacuggaggugaauccaccagagcaaaggauuggucaaugcacuggcugccaucuagaaugcauaaaugggggugugaggcuaaucacucuaaccagugagcucaagucagcuacugucugugcuucccacuuuugcaguucugccacaagugguaagaaaagcacagagauucaauuccacucaggaucauuggucgggaaaacagcaauccauguuaaaggggcauugguagauggaacugaauucacauuugaggguaguugcauguucccagauggaugugaugcaguggacuguacauucugucgugaguuucuaaaaaauccucagugcuacccugccaagaaguggcuguucaucauuauugucauccuccuuggauaugcaggccucaugcuacucaccaauguccuuaaggcaauugggguuuggggaucaugggucauagcuccagugaaacuaauguucgccaucaugaagaaacuaaugagaacugugagcugcuugauggggaaauugauagauaggggaaggcaagugauccaugaggaaauaggagagaauggggagggcaaccgagaugauguuaggauugagauggcaagacccagaaggguaaggcauuggauguacucaccugucauccugaccauucuagcaauaggacuugcugagggcugugaugagaugguccaugcugauucuaaacuuguuucaugcaggcaagggagcggaaauaugaaggaaugugucacaacugggagggcgcuucuuccugcggugaacccaggacaagaggcgugucugcacuucacggcaccugggaguccggacucaaaaugucucaaaauuaagguaaagaggauuaaccuaaaauguaagaagucaucaucauauuuuguuccugaugcccggucuagguguacaucagugaggagaugucguugggcgggagacugccagucugggugccccccucauuucacaucuaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaaguaucuccaugugccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggaaagugcccguaccauaaaaaaagaugggugcauauggaaugcugaccuuguggguauagagcuacgaguggaugacgcugugugcuacucuaagaucacuaguguggaggcaguugcaaacuacucugccauacccaccacuauaggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucagugucuuggagggaguccauagcuacacugucagccucagcuuugaccaugcaguagucgaugagcagugccagcugaacugugggggacaugagagucaagugacucuaaaaggcaaccucaucuuccuggaugucccaaaauuuguggauggcagcuacaugcagacauaucacaguacugugcccacaggggcaaauaucccaagcccuacagauuggcugaaugccuuguuuggcaaugggcugaguagguggauccugggguugauagggguccuauuggggggguuggcucucuuuuucuugaucaugucuuuguucaagcugggaacaaaacaaguauuucgaucgaggacaaagcuggcuuag

SEQ ID NO: 4711 - RNA, 3222 nt, Artificial Sequence
  derived and/or modified CDS sequence (wt) from SFTSV(JS2011-109)__KC505139.1__GP
augaugaaagucaucugguucuccucucugaucugcuuagucauucaaugugguggggauacaggcccaaucaucugcgcaggacccauccacucaaauaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuuggggaucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucaccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucgugggcauagagcuacgaguggaugacgcuguguguuacucuaagaucacuaguguggaggcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccaugugagaugcaaaggggaugagacugccuucagugucuuggagggaguccauagcuacucugucagucucaguuuugaucaugcaguaguugaugagcagugccaacugaacuguggggggcaugagagucaugugacucugagagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguucaagcugggaacaaaacagguauuucgaucgaggacgaagcuggcuuag

SEQ ID NO: 4712 - RNA, 3222 nt, Artificial Sequence
  derived and/or modified CDS sequence (wt) from SFTSV(JS2011-13-2)__KR230770.1__GP
augaugaaagucaucugguucuccucucugaucugcuuagucauucaaugugguggggauacaggcccaaucaucugcgcaggacccauccacucaaacaagagugcugacauaccucaccuacuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagauggguguauauggaaugcugaccucgugggcauagagcuacgaguggaugacgcuguguguuacucuaagaucacuaguguggaggcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacuguggggggcaugagagucauguaacucugaaagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggugugauagggguccuacuggggggauuggcucucuuuuucuugaucaugucuuuguucaagcugggaacaaaacagguauuucgaucgaggacgaagcuggcuuag

SEQ ID NO: 4713 - RNA, 3222 nt, Artificial Sequence
  derived and/or modified CDS sequence (wt) from SFTSV(JS2011-69)__KR230771.1__GP
augaugaaagucaucugguucuccucucuagucugcuuagucauucaaugcaguggggacacaggcccaaucauaugcgcagggcccauccacucgaacaagagugccaacauaccccaccugcuugguuacucugagaagauuugucagauagaucggcugauacauguuucgucauggcugagaaaccacucacaauuucaggguuacguggggcagcgagguggacgcucucaggugaguuacuacccagcugaaaacucuuacucaagguggaguggacuucuuagccccugugaugcugauuggcuugggaugcuugucgugaagaaggccaaggggucugauaugauaguuccugggccuucauacaaggggaaggucuuuuuugaacggccaacuuuugauggauacgugggcuggggcuguggcagugggaagucaaggacugagucaggugaacucugcagcucagacucagggaccaguucuggucuucugccgucagauaggguucucuggauaggugauguggcuugucagcccaugacacccaucccugaggagacauuuuuggagcugaagaguuuuagccagagugaauucccagacauaugcaaaauugauggcauuguguucaaccagugugauagugagagucuaccucagcccuuugaugucgcauggauggauguaggucacucucauaagaucaucaugagggagcacaagaccaaauggguacaagagagcucaucaaaagauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcauaagcccggggaaguuguugugucauauggagggaugcgugucagaccaaaguguuaugguuuuuccagaaugauggcaacacuagaggugaacccuccagagcaaagaauuggccaaugcacuggcugccaucuagagugcauaaaugggggugugaggcuaaucacucuaacuagcgagcucaagucagcuacagucugugcuucucacuuuuguaguucugccacaaguggcaagaaaagcacggagauucaauuccacucagggucauugguugggaaagcagcaauacacguuaaaggggcuuugguggauggaaccgaauucacauuugagggcaguugcauguucccagaugguugugacgcaguggacugcacauucugucgugaguuucuaaaaaauccgcagugcuacccugcaaagaaaugguuguucauuauuauugucauccuccuuggauaugcaggccucaugcuacucaccaauguccuuaaggcaaucgggguuuggggaucaugggucauggcuccagugaagcuaauguuugccaucauaaagaaacugaugagaucugugagcugcuugaugggaaaauugauggauaggggaaggcaggugauccaugaagaaauaggggagaauagagagggcaaccaagaugauguuaggaucgagauggcaagacccagaagggugaggcauuggauguacucaccugucauccugacuauucuagcaauugggcuugcugagggcugcgaugagaugguccaugcagauucuaaacuuguuucgugcagacaagggagcggaaauaugaaggaaugugucacaacugggagggcacuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccuucagcagucauagagcugacaaugcccucgggggaagugaggacauuccaccccaugagcggcauccccacacaagucuucaagggugugagugugacuuacuuaggcucagauauggaggugucuggcuugacugaccugugugagauagaagagcucaaguccaagaagcuggcauuggcucccugcaaucaggcuggcauggggguaguaggcaagguuggagagauacaguguaguagcgaggaaagugcccguaccauaaagaaagauggguguauauggaaugcugaccuugugggcauagagcuacgaguggaugacgcugugugcuacucuaagaucacuaguguggaggcaguugcaaacuacucugccauacccaccacuauuggagggcuaagguuugagagaagccaugacagccaggguaaaauaucugguagcccccuagacaucacagccguaagagggucuuuuucuguuaauuauagaggccuucgauugagccucucagaaauuacugcuacuugcacaggagaggugacgaaugugaguggguguuacucuugcaugacaggcgccaaagucuccaucaaacugcauagcagcaaaaauagcacugcccauguaagaugcaaaggggaugagacugcguucaguguccuggaaggaguucauagcuauacugucagucucagcuuugaccaugcaguggucgaugagcagugccagcugaacuguggggggcaugagagucaagugacucuaaaaggcaaccucaucuuccuggaugucccaaaauuuguagauggcagcuauaugcagacauaucacaguucugugcccacaggggcuaauaucccaagcccuacagacuggcugaaugccuuguuuggcaaugggcugaguagguggauucugggggugauagggguucuacuggggguauuggcucucuucuucuuaaucaugucuuuguucaaacugggaacaaaacaaguauuucgaucaaggacgaagcuggcuuag

SEQ ID NO: 4714 - RNA, 3222 nt, Artificial Sequence
  derived and/or modified CDS sequence (wt) from SFTSV(JS2012-020)__KC505142.1__GP
augaugaaagucaucugguucuccucucugaucugcuuagucauucaaugugguggggauacaggcccaaucaucugcgcaggacccauccacucaaacaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugggggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucggaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauuaucauccuccuuggauaugcaggccucaugcuacucaccaauguucuuaaggcaauugggguuuggggaucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaucuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuugugggcauagagcuacgaguggaugacgcuguguguuacucuaagaucacuaguguggaggcaguugcaaacuacucugcuauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacuguggggggcaugagagucauguaacucugaaagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggugugauagggguccuacuggggggauuggcucucuuuuucuugaucaugucuuuguucaagcugggaacaaaacagguauuucgaucgaggacgaagcuggcuuag

SEQ ID NO: 4715 - RNA, 3222 nt, Artificial Sequence
  derived and/or modified CDS sequence (wt) from SFTSV(JS2012-035)__KC505145.1__GP
augaugaaagucaucugguucuccucucugaucugcuuagucauucaaugugguggggauacaggcccaaucaucugcgcaggacccauccacucaaacaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacugggggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccacagugcuacccugcaaagaaguggcuguucaucauuauugucauccuccuuggauaugcaggccucaugcuacucaccaauguucuuaaggcaauugggguuuggggaucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugccugcacuucacggcaccuggaaguccagacucaaaaugucucaaaauuaagguuaagaggaucaaccuaaaauguaaaaagucaucaucguauuuuguuccugaugcccgguccagguguacaucagugaggagaugucguugggcaggggacugccagucugggugccccccucauuucacauccaacuccuuuucugaugauugggcagguaagauggacagggcuggucugggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugccuucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccgcaccauaaaaaaagaugggugcauauggaaugcagaccucguggguauagagcuacgaguggaugacgcuguguguuacuccaagaucacuaguguggaggcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacuguggggggcaugagagucaugugacucugagagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguucaagcugggaacaaaacagguauuucgaucgaggacgaagcuggcuuag

SEQ ID NO: 4716 - RNA, 3222 nt, Artificial Sequence
  derived and/or modified CDS sequence (wt) from SFTSV(JS2012-79)__KR230772.1__GP
augaugaaagucaucugguucuccucucugaccugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucagguuagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugguagugggaagucuaggacagagucaggggagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaagcuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuucugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguuuaguggcugcucugauggauguggaggagcagccugcggcugcuuuaaugcagccccuucaugcaucuucuggaggaaauggguagagaacccacauggaaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaaacuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcuguguguuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggagggaggucauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4717 - RNA, 3222 nt, Artificial Sequence
  derived and/or modified CDS sequence (wt) from SFTSV(JS2013-44)__KR230773.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagagacaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucacuaauguccucaaggcaauugggauuuggggaucaugggucauagcuccagugaagcuaauguuugccaucauaaagaagcuaaugagaacugugagcugcuugaugaggaaauugauggauagggggaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugccucaaaauuaagguuaagaggaucaaccuaaaauguaaaaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuagacaucucagcuauaagaggaucuuucucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacauugucagucucaguuuugaccaugcaguagucgaugagcagugccaacugaacuguggggggcaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuccaugauuaugucuuuguucaagcugggaacaaaacagguauuucgaucaaggacaaagcuggcuuag

SEQ ID NO: 4718 - RNA, 3222 nt, Artificial Sequence
  derived and/or modified CDS sequence (wt) from SFTSV(JS2013-46)__KR230774.1__GP
augaugaaagucaucugguucuccucucugaucugcuuagucauucaaugcgguggggauacaggcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgaucucaggugagcuacuacccagcugaaaauucuuacucaagguggaguggacuucuaagccccugugaugcugauuggcuugggaugcuugucgugaagaaggccaaggggucugauaugauaguuccagggccuucauacaaggggaaagucuuuuuugaacggccaacuuuugauggauacguaggcuggggcugugguagcgggaagucuaggacugagucaggugagcucugcaguucagacuccgggacuaguucuggucuucugcccucagauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacuggaccuuguucugaaucagaagaaaagacuugcaagaccaguggaucaugcaggggggacaugcaguuuugcaagguggcagguugugaacauggggaagaggcaucugaagccaagugcagaugcucacuugugcacaagcccggggaagucguugugucauauggagggaugcgugucagaccaaagugcuacgguuucuccagaaugauggcaacacuggaggugaacgaaccagagcagaggauuggucaaugcacuggcugccaucuagaaugcauaagugggggugugaggcuaaucacucuaaccagugagcucaagucagcuacugucugcgcuucucacuucuguaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauagaggaaggcaagugauccaugaggaaauaggggagaauagagagggcaaccaagaugauguuaggauugagauggccagacccaggaggguaaggcauuggauguacucgccugucauccugacuauucuagcaauggggcuugcugagggcugugaugagaugguccaugcugauucuaaacuuguuucgugcaggcaagggagcggaaauaugaaggaaugugucacaacugggagggcgcuucuuccugcagugaacccagggcaagaggcgugucugcacuucauggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugugguugcuuuaaugcggccccuucuugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccagggcaaaauaucugguagcccccuggacaucacagcuauaagaggaucuuuuucuaucaauuauagaggccuucgacugagccucucagaaauuucugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauagcacugugcccacaggggcaaauaucccaagccccacagauuggcuaaaugccuuguuuggcaaugggcugaguagguggauccugggggugauagggguccuacuggggggauuggcucucuuuuucuugaucaugucuuuguucaagcugggaacaaaacagguauuucgaucgaggacgaagcuggcuuaa

SEQ ID NO: 4719 - RNA, 3222 nt, Artificial Sequence
  derived and/or modified CDS sequence (wt) from SFTSV(JS2013-52)__KR230775.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucgggagagcucugcaguucagacucagggacuagcucuggucuucugcccucagauaggguucucuggauaggugauguggcuugucagcccaugacacccaucccugaggagacauuuuuggagcugaagaguuuuagccagagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagguguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaagaaagaugggugcauauggaaugcagaccuugugggcauagagcuacgaguagaugacgccgugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagccucucagaaauuacugcuaccugcacaggagaggugacaaaugugaguggauguuauucuugcaugacaggcgccaaagucucuaucaaacugcacagcagcaaaaauagcacugcccauguaagaugcaaaggggaugagacugccuucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuggggguauuggcucucuucuucuuaaucaugucuuuguucaaacugggaacaaaacaaguauuucgaucaaggacgaagcuggcuuag

SEQ ID NO: 4720 - RNA, 3222 nt, Artificial Sequence
  derived and/or modified CDS sequence (wt) from SFTSV(JS2013-69)__KR230776.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcuaagaaaccacucacaauuucagggcuacguagggcagcgagguggacgcucucaggugagcuacuacccagcugaaaacucuuacucaagguggaguggacuucuaagccccugugaugcugauuggcuugggaugcuugucgugaagaaggccaaggggucugauauuauaguuccugggccuucauacaaggggaaagucuuuuuugagcggccaacuuuugauggauauguaggcuggggcugugguagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccaaugugagggugagagucuaccucagccuuuugauguugcauggauggauguuggccacucucauaaaaucaucaugagggagcacaagaccaaauggguacaagagagcucaucaaaagauuuugugugcuauaaggaagggacugggccuuguucugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuggagaguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagguguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcggccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaagagcucaaguccaagaagcuggcauuggcucccugcaaucaggcuggcauggggguaguaggcaagguuggagagauacagugcaguagcgaggaaagugcccguaccauaaagaaagauggguguauauggaaugcugaccuugugggcauagagcuacgaguggaugacgcugugugcuacucuaagaucacuaguguggaggcaguugcaaacuacucugccauacccaccacuauuggagggcuaagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggguguuacucuugcaugacaggcgccaaagucuccaucaaacugcauagcagcaaaaauagcacugcccauguaagaugcaaaggggaugagacugcguucaguguccuggaaggaguucauagcuauacugucagucucagcuuugaccaugcaguggucgaugagcagugccagcugaacuguggggggcaugagagucaagugacucuaaaaggcaaccucaucuuccuggaugucccaaaauuuguagauggcagcuauaugcagacauaucacaguucugugcccacaggggcuaauaucccaagcccuacagacuggcugaaugccuuguuuggcaaugggcugaguagguggauucugggggugauagggguucuacuggggguauuggcucucuucuucuuaaucaugucuuuguucaaacugggaacaaaacaaguauuucgaucaaggacgaagcuggcuuag

SEQ ID NO: 4721 - RNA, 3222 nt, Artificial Sequence
  derived and/or modified CDS sequence (wt) from SFTSV(JS2013-71)__KR230777.1__GP
augaugaaagucaucugguucuccucucugaucugcuuugucauucaaugugguggggauacaggcccaaucaucugcgcaggacccauccacucaaauaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuuguugugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcauaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuuggggaucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucaccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucgugggcauagagcuacgaguggaugacgcuguguguuacucuaagaucacuaguguggaggcaguugcaaacuacucugccauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccaugugagaugcaaaggggaugagacugccuucagugucuuggagggaguccauagcuacucugucagucucaguuuugaucaugcaguaguugaugagcagugccaacugaacuguggggggcaugagagucaugugacucugagagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguucaagcugggaacaaaacagguauuucgaucgaggacgaagcuggcuuag

SEQ ID NO: 4722 - RNA, 3222 nt, Artificial Sequence
  derived and/or modified CDS sequence (wt) from SFTSV(JS2014-03)__KR230778.1__GP
augaugaaagucaucugguucuccucucugaucuacuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaacguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguugugggcaggguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugcuauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacagcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4723 - RNA, 3222 nt, Artificial Sequence
  derived and/or modified CDS sequence (wt) from SFTSV(JS2014-16)__KR230780.1__GP
augaugaaagucaucugguucuccucucugaucugcuuagucauucaaugcaguggggauacaggcccaaucauaugcgcagggcccauccacucgaacaagagugccaacauaccccaccugcuugguuacucugagaagauuugucagauagaucggcugauacauguuucgucauggcugagaaaccauucacaauuucagggcuacguggggcagcgagguggucgcucucaggugaguuacuacccagcugaaaacucuuacucaagguggaguggacuucuaagccccugugaugcugauuggcuugggaugcuugucgugaagaaggccaaggggucugauaugauaguuccugggccuucauacaaggggaaggucuuuuuugaacggccaacuuuugauggauacgugggcuggggcuguggcagugggaagucaaggacugagucaggugaacucugcagcucagacucagggaccaguucuggucuucugccgucagauaggguucucuggauaggugauguggcuugucagcccaugacacccaucccugaggagacauuuuuggagcugaagaguuuuagccagagugaauucccagacauaugcaaaguugauggcauuguauucaaccagugugauagugagagucuaccucagcccauugaugucgcauggauggauguaggucacucucauaagaucaucaugagggagcacaagaccaaauggguacaagagagcucaucaaaagauuuugugugcuacaaggaaggaacugggccauguucugaaucggaagaaaagacuuguaagaccaguggaucaugcaggggggacaugcaguuuugcaagguggcagguugugaacauggggaagaggcaucugaagccaaguguagaugcucacuagugcauaagcccggggaaguuguugugucauauggagggaugcgugucagaccaaaguguuaugguuuuuccagaaugauggcaacacuagaggugaacccuccugagcaaagaauuggccaaugcacuggcugccaucuagaaugcauaaaugggggugugaggcuaaucacucuaacuagcgagcucaagucagcuacugucugugcuucccacuuuuguaguucugccacaaguggcaagaaaagcacggagauucaauuccacucagggucauugguugggaaagcagcaauacacgucaaaggggcuuugguggauggaacugaauucacguuugagggcaguugcauguucccagaugguugugacgcaguggacugcacauucugucgugaguuucuaaaaaauccgcagugcuacccugcaaagaaaugguuguucauuauuauugucauccuccuuggauaugcaggccucaugcuacucaccaauguccuuaaggcaaucgggguuuggggaucaugggucauggcuccagugaagcuaauguuugccaucauaaagaaacugaugagaucugugagcugcaugaugggaaaauugauggauaggggaaggcaagugauccaugaagaaauaggggagaauagagagggcaaccaagaugauguuaggaucgagauggcaagacccagaagggugaggcauuggauguacucaccugucauccugacuauucuagcaauugggcuugcugagggcugcgaugagaugguccaugcagauucuaaacuuguuuugugcagacaagggagcggaaauaugaaggaaugugucacaacugggagggcacuccuuccugcgguuaacccaggacaagaagcaugucugcacuucacggcaccugggaguccggacucaaaaugucucaagaucaagguuaagaggaucaaccuaaaauguaagaagucaucaucauauuuuguuccugaugcucgguccagguguacaucugugaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccuucagcagucauagagcugacaaugcccucgggggaagugaggacauuccaccccaugagcggcauccccacacaagucuucaagggugugagugugacuuacuuaggcucagauauggaggugucuggcuugacugaccugugugagauagaagagcucaaguccaagaagcuggcauuggcucccugcaaucaggcuggcauggggguaguaggcaagguuggagagauacaguguagcagcgaggaaagugcccguaccauaaagaaagauggguguauauggaaugcugaccuugugggcauagagcuacgaguggaugacgcugugugcuacucuaagaucacuaguguggaggcaguugcaaacuacucugccauacccaccacuauuggagggcuaagguuugagagaagccaugacagccaggguaaaauaucugguagcccccuagacaucacagccauaagaggguccuuuucgguuaauuauagaggccuucgacugagccucucagaaauuacugcuacuugcacaggagaggugacgaaugugaguggguguuacucuugcaugacaggcgccaaagucuccaucaaacugcauagcagcaaaaauagcacugcccauguaagaugcagaggggaugagacugcguucaguguccuggaaggaguucauaguuacacugucagucucagcuuugaccaugcaguggucgaugagcagugccagcugaacuguggggggcaugagagucaagugacucuaaaaggcaaccucaucuuccuggaugucccaaaauuuguagauggcagcuauaugcagacauaucauaguucugugcccacaggggcuaauaucccaagcccuacagacuggcugaaugccuuguuuggcaaugggcugaguagguggauucugggggugauagggguucuacuggggguauuggcucucuucuucuuaaucaugucuuuguucaaacugggaacaaaacagguauuucgaucaaggacgaagcuggcuuag

SEQ ID NO: 4724 - RNA, 3222 nt, Artificial Sequence
  derived and/or modified CDS sequence (wt) from SFTSV(JS2014-18)__KR230781.1__GP
augaugaaagucaucugguucuccucucugaucugcuuagucauucaaugcgguggggauacgggcccaaucaucugugcaggacccauccacucaaacaagagugcugacauaccccaccugcuuggcuacucugagaagauuugucagauagaucggcugauacauguuucgucauggcucagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggcccucauacaagggaaaagucuuuuuugaacggccaacuuuugauggauacguaggcuggggcugugguagugggaagucuaggacugagucaggugagcucugcaguucagacuccgggacuagcucuggucuucugcccucggauaggguucucuggauaggugauguugcuugucagccuacgacacccaucccugaggagacauuucuggagcugaagagcuuuagccaaagugaauucccagauguaugcaaaauugauggcauuguguucaaccagugugagggugagagucuaccucagcccuuugauguugcguggauggauguuggccacucucauaaaaucaucaugagggagcacaagaccaaaugggugcaagagagcucauccaaggauuuugugugcuacaaggaagggacugggccuuguucugaaucagaggaaaagacuugcaagaccaguggaucaugcaggggggacaugcaguuuugcaagguggcagguugugaacauggggaagaggcaucugaagccaaguguagauguucacuugugcacaagcccggggaagucguugugucauauggagggaugcgugucagaccaaagugcuaugguuucuccagaaugauggcaacacuggaggugaacccaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguugggaagacagcaauccacgucaaaggggcauugguagauggaacugaauucacauuugaggguagcugcauguucccagaugguugugaugcaguggacugcacauucugucgugaguuucuaaaaaauccucagugcuacccugcaaagaaguggcuguucaucauuauugucauccuccuaggauaugcaggccucaugcuacucaccaauguucuuaaggcaauugggguuugggggucaugggucauagccccagugaagcuaguguuugccaucauaaagaaacuaaugagagcugugagcugccugauggggaaauugauggauaggggaaggcaagugauccaugaggaaauaggggagaauagagagggcaaccaagaugauguuaggaucgagauggccagacccaggaggguaaggcauuggauguacucgccugucauccugacuauucuagcaauagggcuugcugagggcugugaugagaugguccaugcugauucuaaacuuguuucaugcaggcaagggagcggaaauaugaaggaauguguuacaacugggagggcgcuucuuccugcggugaacccugggcaagaggcgugucugcacuucacggcaccuggaaguccggacucaaaaugucucaaaauuaagguuaagaggaucaaccuaaaauguaagaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggguguggaggagcagccugcgguugcuuuaaugcggccccuucaugcauuuucuggaggaaauggguagagaauccacaugggaucaucuggaaaguaucuccaugugccgcaugggucccaucagcaguuauagagcuaacaaugcccucaggggaggugaggacauuccaccccaugagcggaauccccacacaagucuucaagggugugaguguaacuuacuugggcucagacauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaagaaagaugggugcauauggaaugcugaccucguggguauagagcugcgaguggaugacgcugugugcuacucuaagaucacuaguguggaggcaguugcaaacuacuccgccauacccaccacuauuggggggcugagguuugagagaagccaugacagccaggguaaaauaucuggaagcccccuggacaucacagcuauaagaggauccuuuucuguuaauuauagaggccuucgacugagucucucagaaauuacugcuacuugcacaggggaagugacaaaugugaguggguguuauuccugcaugacaggcgccaaagucuccaucaaauugcauagcagcaaaaauagcacugcucaugugagaugcaaaggggaugagacugcauucagugucuuggagggaguccauagcuacucugucagucuaaguuuugaucaugcaguagucgaugagcagugccaacugaacugugggggacaugagagucaagugacucuaagaggcaaccucaucuuccuggaugucccgaaauuuguggauggcagcuacaugcagacauaucauaguacugugcccacaggggcaaauaucccaagcccuacagauuggcugaaugccuuguuuggcaaugggcugaguagguggauucugggggugauagggguccuacuggggggauuggcucucuuuuucuugaucaugucuuuguucaagcugggaacaaaacagguauuucgaucgaggacgaaacuggcuuag

SEQ ID NO: 4725 - RNA, 3222 nt, Artificial Sequence
  derived and/or modified CDS sequence (wt) from SFTSV(JS2014-31)__KR230782.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugguagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugagggcaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacauggaaucaucuggaaaguaucuccuugugccgcaugggucccaucggcagucauagagcuaacaaugcccucaggggaggugaggacauuccaccccaugaguggaauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcuguguguuacucuaagaucacuaguguggaagcaguugcaaacuacucugccauacccaccacuauuggggggcugagguucgagagaagccaugacagccaggguaaaauaucugguagcccccuggacaucacagcuauaagagggucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugccuucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuggggguauuggcucucuucuucuuaaucaugucuuuguucaaacugggaacaaaacagguauuucgaucaaggacgaagcuggcuuag

SEQ ID NO: 4726 - RNA, 3222 nt, Artificial Sequence
  derived and/or modified CDS sequence (wt) from SFTSV(JS2014-33)__KR230783.1__GP
augaugaaagucaucugguucuccucucugaucugcuuugucauucaaugcaguggggacucgggcccaaucaucugcgcaggacccauccacucaaacaagagugcugacauaccccaccugcuggguuacucugagaagauaugucagauagaucggcugauacauguuucgucauggcucagaaaccacucacaauuucagggcuacguaggccagcgagguggacgcucucaggugagcuacuacccagcugaaaauucuuacucaagguggagugggcuucuaagccccugugaugcugauuggcuugggaugcuugucgugaaaaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuagugcacaagcccggagaagucguugugucauauggagggaugcgugucagaccaaagugcuaugguuucuccagaaugauggcaacacuggaggugaaccagccagagcaaaggauuggucaaugcacuggcugccaucuggaaugcauaaaugggggugugaggcuaauaacucuaaccagugagcucaagucagcuacugucugugccucccacuuuuguaguucugccacgaguggcaagaaaagcacggagauucaauuccacucgggaucauugguugggaaaacagcaauacacgucaaaggggcauugguagauggaacugaauucacauuugaggguaauugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagagcugugggcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggggcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacauccgugaggagaugucguugggcuggagacugccagucugggugccccccucauuucacauccaacuccuuuuccgaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauuccugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuauaugcagacauaucauagcgcugugcccacaggggcaaauaucccaaguccaacagacuggcugaaugccuuguuuggcaaugggcugaguagguggauccugggggugauagggguucugcuugggggguuggcucucuuuuucaugauuaugucuuuguucaagcugggaacaaaacaggcauuucgaucaaggacgaagcuggcuuag

SEQ ID NO: 4727 - RNA, 3222 nt, Artificial Sequence
  derived and/or modified CDS sequence (wt) from SFTSV(JS2014-39)__KR230784.1__GP
augaugaaagucaucugguucuccucucugaccugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucagguuagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugggagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagagacaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucacuaauguccucaaggcaauugggauuuggggaucaugggucauagcuccagugaagcuaauguuugccaucauaaagaagcuaaugagaacugugagcugcuugaugaggaaauugauggauagggggaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugccucaaaauuaagguuaagaggaucaaccuaaaauguaaaaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuagacaucucagcuauaagaggaucuuucucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacauugucagucucaguuuugaccaugcaguagucgaugagcagugccaacugaacuguggggggcaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuccaugauuaugucuuuguucaagcugggaacaaaacagguauuucgaucaaggacaaagcuggcuuag

SEQ ID NO: 4728 - RNA, 3222 nt, Artificial Sequence
  derived and/or modified CDS sequence (wt) from SFTSV(JS2014-H.longicornis-02)__KR230786.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugguagugggaagucuaggacagagucaggagagcucugcaguucagacucagggacuagcucuggucuucugcccucagauaggguucucuggauaggugauguugcuugucagccuaugacacccaucccuguagaggcauuucuggagcugaagaguuuuagccaaagugaauucccagacauaugcaaaauugauggcauuguguucaaccagugugagggugagaguuuaccucagccuuuugauguugcauggauggauguuggccacucucauaaaaucaucaugagggagcacaagaccaaaugggugcaagagagcucauccaaggauuuugugugcuauaaggaagggacugggccuuguccugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacauggaaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcuguguguuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugccuucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4729 - RNA, 3222 nt, Artificial Sequence
  derived and/or modified CDS sequence (wt) from SFTSV(JS2014-H.longicornis-03)__KR230787.1__GP
augaugaaagucaucugguucuccucucugaccugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucagguuagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugguagugggaagucuaggacagagucaggggagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcaguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagaggguaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcuuuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacagcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggagcaaauaucccaagcccaacagacuggcugaaugccuuguuuggcaaugggcugagcagguggauccugggggugauagggguucugcuugggggguuggcucucuuuuuuaugauuaugucuuuguucaagcugggaacaaaacagguauuucgaucaaggacaaagcuggcuuag

SEQ ID NO: 4730 - RNA, 3222 nt, Artificial Sequence
  derived and/or modified CDS sequence (wt) from SFTSV(JS2014-Hedgehog-02)__KR230789.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcucgggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucuguaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaaggaacugggccuuguucugaaucagaagaaaagacuugcaagaccaguggaucaugcaggggggacaugcaguucugcaagguggcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggauuggucaaugcacuggcugccaucuggaaugcauaaaugggggugugaggcuaauaacccuaaccagugagcucaagucagcuacugucugugcuucccacuuuuguaguucugccacgaguggaaagaaaagcacggagauucaauuccacucaggaucauugguugggaaaacagcaauacacgucaaaggggcauugguagauggaacugaauucacauuugaggguaguugcauguucccagaugguugugaugcgguggacugcaccuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcuguucugauggauguggaggagcagccugcggcugcuuuaacgcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucugaaauuacugcuaccugcacaggggaagugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccuggggguaauagggguucugcuugggggguuggcucucuuuuucaugauuaugucuuuguucaagcugggaacaaaacagguauuucgaucaaggacaaagcuggcuuag

SEQ ID NO: 4731 - RNA, 3222 nt, Artificial Sequence
  derived and/or modified CDS sequence (wt) from SFTSV(KACNH)__KU507558.1__GP
augaugaaagucaucugguucuccucucugaucugcuuagucauucaaugcaguggggauucgggcccaaucaucugcgcaggacccauccacucaaacaagagugcuagcauaccccaccugcuugguuacuccgagaagauuugucagauagaucggcugauacauguuucgucauggcucaggaaccacucgcaauuucaaggcuacguagggcagcgagguggacgaucccaggugagcuacuacccagcugagaauucuuacucgagguggaguggacuucuaagccccugugaugcugauuggcuugggaugcuugucgugaagaaggccaaggggucugacaugauaguuccugggccuucauacaaggggaaagucuuuuuugaacgaccaacuuuugauggauacguuggcuggggcuguggcaguggaaagucuaggacugagucaggagagcucugcaguucagacucagggacuagcucuggucuucugcccucggauaggguucucuggauaggugauguugcuugucagccuaugacacccaucccugaggagacauuucuggagcuaaagaguuuuagccaaagugaauucccagacauaugcaaaauugauggcauuguguucaaccagugugagggugagagucugccccagcccuuugauguagcauggauggauguuggccacucucauaaaaucaucaugagggagcacaagaccaaauggguacaagagagcucauccaaggauuuugugugcuacaaggaagggacugggccuuguucugaaucagaagaaaaggcuugcaagaccaguggaucaugcaggggggacaugcaguuuugcaagguggcagguugugaacauggggaggaggcaucugacgccaaguguagaugcucacuugugcacaagcccggggaagucguugugucauauggagggaugcgugucagaccaaagugcuaugguuucuccagaaugauggcaacacuggaggugaacccaccagagcaaaggauuggucaaugcacuggcugccaucuagaaugcauaaaugggggugugaggcuaaucacucuaaccagugagcucaagucagcuacugucugugcuucccacuuuugcaguucugcuacaagugguaagaaaagcacggagauucaauuccacucaggaucauugguugggaaaacagcaauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucauccucauugucauccuccuuggauaugcaggccucaugcuaaucaccaauguccuuaaggcaauugggguuugggggucauggguaauagcuccagugaagcuaauguuugccauuauaaagaaacuaaugagaacugugagcugcuugauggggaaauugauggauaggggaaggcaagugauccaugaggaaaucggggagaauggggagggcaaucaagaugauguuaggauugagauggcaagaccuagaagagugaggcauuggauguacucaccugucauccugaccauucuagcaauagggcuugcugagggcugugaugagaugguccaugcugauucuaaacucguuucaugcaggcaagggagcggaaauaugaaggaaugugucacaacugggagggcgcuucuuccugcggugaacccaggacaagaagcaugucugcacuucacggcaccugguaguccggacucaaagugucucaaaauuaagguuaagaggauuaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaaguaucuccaugcgccgcaugggucccaucagcaguuauagagcuaacaaugcccucaggugaggugaggacauuccaccccaugaguggcauccccacacaagucuucaagggugugaguguaacuuacuugggcucagauauggaggugucuggcuugacugaccugugugagauagaagagcucaaguccaagaagcuagcauuagcucccugcaaccaggcuggcauggggguuguaggcaagguuggagagauacagugcaguagcgaggaaagugcccguaccauaaaaaaggaugggugcauauggaaugcagaccugguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacggcuauaagaggauccuuuucuguuaacuacagaggccuucgauuaagucucucagaaauuacugcaacuugcacaggggaggugacaaaugugaguggguguuauucuugcaugacaggcgccaaagucuccaucaaauugcauagcagcaaaaauagcacugcccauguuagaugcaaaggagaugagacugcauucagugucuuggagggaguccauagcuauacugucagccucagcuucgaccaugcuguagucgaugagcagugccaacugaacugugggggacaugagagucaagugacucuaaaaggcaaccucaucuuccuggaugucccaaaauuuguggauggcagcuacaugcagacauaucacaguacugugcccacaggggcaaauaucccaagccccacagauuggcugaaugccuuguuuggcaaugggcugaguagguggauccugggggugauagggguucuacuagggggauuggcucucuuuuucuugaucaugucuuuguucaagcuggguacaaaacagguauuucgaucgaggacgaagcuggcuuag

SEQ ID NO: 4732 - RNA, 3222 nt, Artificial Sequence
  derived and/or modified CDS sequence (wt) from SFTSV(KACNH2)__KU507559.1__GP
augaugaaagucaucugguucuccucucugaucugcuuagucauucaaugcaguggggacacgggcccaaucauaugcgcaggacccauccacucaaacaagagugccaacauaccccaccugcuugguuacucugagaagauuugccagauagaucggcugauacauguuucgucauggcugagaaaccauucacaauuucagggcuacguggggcagcgagguggacgcucucagguaaguuacuacccagcugaaaacucuuacucaagguggaguggacuucuaagccccugugaugcugauuggcuugggaugcuugucgugaagaaggccaaggggucugauaugauagucccugggccuucauacaaggggaaagucuuuuuugaacguccaacuuuugauggauacgugggcuggggcuguggcagugggaagucaaggacagagucaggugagcucuguagcucagacucagggaccaguucuggucuucugcccuccaauaggguucucuggauaggugauguugcuugccagcccaugacacccaucccugaggagacauuucuagagcugaagaguuucagccagagugaauucccagacauaugcaaaauugauggcauuguguucaaccagugugagagugagagccuaccucagcccuuugaugucgcauggauggauguaggucacucucauaaaaucaucaugagggagcacaagaccaaauggguacaagagagcucauccaaggauuuugugugcuacaaggaagggacugggccguguucugaaucagaagaaaggacuugcaagaccaguggaucaugcaggggggacaugcaguuuugcaaggucgcagguugugaacauggggaagaggcaucugaagccaaguguagaugcucccuaguacacaagcccggggaaguuguugugucauauggagggaugcgugucagaccaaaguguuaugguuucuccagaaugauggcaacacuagaggugaacccuccagagcaaagaauuggccaaugcacuggcugccauauagaaugcauaaaugggggugugaggcuaaucacucuaacuagugagcucaagucagcaacugucugugcuucccacuuuuguaguucugccacaaguggcaagaaaagcacggagauucaauuccacucaggaucauuaguugggaaagcugcaauacacgucaaaggggcuuugguggauggaacugaauucacauuugagggcaguugcauguuuccagaugguugugacgcuguggacugcacauucugucgugaguuccuaaaaaauccucagugcuacccugcaaagaaaugguuguucauuauuauugucauccuccuuggauaugcaggccucaugcuacucaccaauguccuuaaggcaaucgggguuuggggaucaugggucauagcuccagugaagcuaauguuugccaucauaaagaaacuuaugagaucugugagcugcuugauggggaaauugauggauaggggaagacaagugauccaugaagaaauaggggagaauagagagggcaaccaagaugauguuaggaucgagauggcaagacccagaagggugaggcauuggauguacucaccugucauccugacuauucuagcaauugggcucgcugagggcugcgaugagaugguccaugcagauucuaaacuugugucgugcaggcaagggggcggaaauaugaaggaaugugucacaacuggaagggcgcuccuuccugcagugaacccaggacaagaggcaugucugcacuucacggcuccugggaguccggacucaaaaugucucaaaaucaagguuaagaggaucaaccuaaaauguaagaagucaucaucauauuuuguuccugaugcucgguccagguguacaucuguaaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuuuuggagaaaauggguagagaauccacaugggaucaucuggaaaguauccccaugugcugcaugggucccuucagcagucauagagcuaacaaugcccucgggggaagugaggacauuccaccccaugagcggcauccccacucaagucuucaagggugugagugugacuuacuuaggcucagauauggaggugucuggcuugaccgaccugugugagauagaagaacucaaguccaagaagcuggcauuagcucccugcaaucaggcuggcaugggggucguaggcaagguuggagagauacagugcaguagcgaggaaagcgcccguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagcuauaagaggguccuuuucagucaauuauagaggccuucgacugagccucucagaaauuacugcuacuugcacaggugaggugacgaaugugaguggguguuacucuugcaugacaggcgccaaagucuccaucaaacugcauagcagcaaaaauagcacugcccaugugagaugcaaaggggaugagaccgcauucaguguccuggagggaauucauagcuauacugucagucucagcuuugaucaugcaguggucgaugagcagugccaacugaacuguggagggcaugagagucaagugacucuaaagggcaaccucaucuuccuggaugucccaaaauuuguagauggcagcuauaugcagacauaucauaguucugugcccacaggggcuaauaucccaagcccaacagacuggcugaaugccuuguuuggcaaugggcugaguagguggauucugggggugauagggguucuacuggggggauuggcucucuucuucuuaaucaugucuuuguucaaacuggggacaaaacagguauuucgaucaaggacaaagcuggcuuag

SEQ ID NO: 4733 - RNA, 3222 nt, Artificial Sequence
  derived and/or modified CDS sequence (wt) from SFTSV(KACNH3)__KP663744.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucagguaagcuacuacccagcugaaaacucuuacucaagguggaguggacuucuaagccccugugaugcugacuggcuugggaugcuuguugugaagaaagccaaagggucugauaugauaguuccugggccuucauacaaggggaaagucuuuuuugaacggccaacuuuugauggauacguaggcuggggcuguggcagugggaagucaaggacagagucaggggagcucugcagcucagacucagggaccaguucaggucuucugcccucagauaggguucucuggauaggugauguugcuugccagccuaugacacccaucccugaggagacauuucuggagcugaagagcuuuagccagagugaauucccagacauaugcaaaauugaugguauaguguucaaccagugugagagugagagucuaccucaacccuuugauguugcauggauggauguaggccacucucauaaaaucaucaugagggagcacaagacuaaauggguacaagagagcucaucuaaggauuuugugugcuacaaggaagggacuggcccguguucugaaucagaagagaagacuugcaagaccaguggaucauguaggggggacaugcaguuuugcaagguggcagguugugaacacggggaagaggcaucuggugccaaguguagaugcucacuagugcacaagcccggggaaguuguugugucauauggagggaugcgugucagaccaaaguguuauggcuucuccagaaugauggcaacacuagaggugaacccaccagagcaaaggauuggccaaugcacuggcugccaucuagaaugcauaaaugggggugugaggcugaucacucugacuagugagcucaagucagcuacugucugugcuucccacuuuuguaguucugccacaaguggcaagaaaagcacggagauucaauuccacucagggucauuaguugggaaaacagcaauacacgucaaaggggcuuugguggauggaacugaauucacauuugagggcaguugcauguucccagaugguugugacgcaguggacugcacauucugucgugaguuucuaaaaaauccucagugcuauccugcaaagaaaugguuguucaucaucauugucauccuccuuggauaugcaggccucaugcuacucaccaauguccuuaaggcaaucgggguuuggggaucaugggucauagcuccagugaagcuaauguuugccaucauaaagaaacugaugagauccgugagcugcuugauggggaaguuaauggauaggggaaggcaaguaauccaugaagaaauaggggagaauagagagggcaaccaggaugauguuaggaucgagauggcaagacccagaaggguaaggcauuggauguacucaccugucauccugacuauucuagcaauugggcuugccgaaggcugcgaugagaugguccaugcagacuccaaacuuguuucgugcaagcaggggagcggaaauaugaaggaaugugucacaacugggagggcacuccuuccugcggugaacccaggacaagaggcaugucugcacuucacggcaccugggaguccggacucaaaaugucucaaaauaaagguuaagaggauaaaccuaaaauguaagaagucaucaucauauuuuguaccugaugcucggucuagguguacaucugugaggagaugucgcugggcaggagacugccagucugggugccccucucauuucacguccaacuccuuuucugaugauugggcagguaaaauggacagggcaggucuaggauucagugggugcucugauggguguggaggagcagccugcggcugcuuuaaugcagccccuucaugcaucuuuuggaggaaauggguagagaacccgcaugggaucaucuggaaaguaucuccaugugcugcaugggucccaucagcugucauagagcuaacaaugcccucaggggaagugaggacauuccaccccaugagcggcaucccuacacaagucuucaagggugugagugugacguacuuaggcucagauauggaggugucuggcuugacugaccugugugaaauagaagagcucaaguccaagaagcuggcauuagcucccugcaaucaggcuggcauggggguuguaggcaagguuggagagauacagugcaguagcgaggaaagcgcccguaccauaaaaaaagauggguguauauggaaugcugaccuugugggcauagagcuacgaguggaugacgcugugugcuacucuaagaucacuaguguggaggcagucgcaaacuacucugccauacccaccacuauuggggggcugagguuugagagaagccaugacagccaggguaaaauaucugguagcccccuagacaucacagccauaagggggucuuuuucaguuaauuauagaggccuucgacugagccucucagaaguuacugcuacuugcacaggagagguaacgaaugugaguggguguuacucuugcaugacaggcgccaaagucuccaucaaacugcacagcaguaaaaauagcacugcccauguaagaugcaaaggggaugagacagcguucaguguacuagagggaguucauagcuauacuguaagucucagcuuugaccaugcuguggucgaugagcagugccagcugaacuguggggggcaugagagccaagugacucuaaaaggcaaccucaucuuccuggaugucccaaaauuuguagauggcagcuauaugcagacauaucauaguucugugcccacaggggcuaauaucccaagcccuacagacuggcugaaugccuuguuuggcaaugggcugagcagguggauucuggggguaauagggguucuacuggggggauuggcucucuuuuucuuaaucaugucuuuguucaaauugggaacaaaacagguauuucgaucaaggacgaagcuggcuuag

SEQ ID NO: 4734 - RNA, 3222 nt, Artificial Sequence
  derived and/or modified CDS sequence (wt) from SFTSV(KADGH)__KU507548.1__GP
augaugaaagucaucugguucuccucucugaucugcuuagucauccaaugcaguggggacacgggcccaaucauaugcgcagggcccauccacucaaacaagagugccaacauaccccaccugcuugguuacucugagaagauuugucagauagaucgacugauacauguuucgucauggcugagaaaccauucacaguuucagggcuacguggggcagcgagguggacgcucucaggugagcuacuacccagcugaaaacucuuacucaagguggagcggacuucuaagccccugugaugcugauuggcuugggaugcuugucgugaagaaggccaaggggucugauaugauaguuccugggccuucauacaaggggaaagucuuuuuugaacggccaacuuuugauggauacgugggcuggggcuguggcagugggaagucaaggacagagucaggugaacucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagaguuuagcucagcccuuugaugucgcauggauggauguaggucacucucauaaaaucaucaugagggagcacaagaccaaauggguacaagagagcucaucuaaggauuuugugugcuacaaggaaggaacugggccguguucugaaucagaagaaaagacuugcaagaccaguggaucaugcaggggggauaugcaguuuugcaagguggcagguugugaacauggggaagagacaucuguagccaaguguagauguucucuagugcacaagcccggggaaguuguugugucauauggagggaugcgugucagaccaaaguguuaugguuucuccagaaugauggcaacacuagaggugaacccaccagagcaaagaauuggccaaugcacuggcugccaucuagaaugcauaagugggggugugaggcuaaucacucuaacuagugagcucaagucagccacugucugugcuucccacuuuuguaguucugccacaaguggcaagaaaagcacggagauucaauuccacucagggucauuaguugggaaagcagcaauacacgucaaagggguuuugguggauggaacugaauucacauuugagggcaguugcauguucccagaugguugugacgcaguggauugcacauucugucgugaguuucuaaagaauccucagugcuacccugcaaagaaaugguuguucauuauuauugucauccuccuuggauacgcaggccucaugcuacucaccaauguccuuaaggcaaucgggguuuggggaucaugggucauagcuccagugaagcuaauguuugcuaucauaaagaaacugaugagaucugugagcugcuugauggggaaauugauggauaggggaaggcaagugauccaugaagaaauaggggagaauagagagggcaaccaagaugauguuaggaucgagauggcaagacccagaagggugaggcauuggauguacucaccugucauccugacuauucuagcaauugggcuagcugagggcugcgaugagaugguccaugcugauucuaaacuuguuucgugcagacaagggagcgggaacaugaaagaaugugucacaacugggagggcgcuccuuccugcggugaacccaggacaagaggcaugucugcacuucacggcaccugggagcccggacucaaaaugucucaaaaucaagguuaagaggaucaaccuaaaauguaagaagucaucaucauauuuuguuccugaugcucgauccagguguacaucugugaggagaugucgcugggcaggagacugucagucugggugccccucucauuucacguccaacuccuucucugaugauugggcaggaaaaauggacagggcuggucuaggauucagugggugcucagauggauguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacgaugcccucgggggaagugagaacauuccaccccaugagcggcauccccacacaagucuucaagggugugagugugacuuacuuaggcucagauauggaggugucuggcuugacugaccugugugagauagaagagcuaaaguccaagaagcuggcauuagcucccugcaaucaggcuggcauggggguuguaggcaagguuggagagauacaaugcagcagcgaggaaagcgcccguacuauaaagaaagauggguguauauggaaugcugaccuuguaggcauagagcuacggguggaugacgcuguaugcuacucuaagaucacuaguguggaggcaguugcaaacuacucugccauacccaccacuauuggggggcugagguuugagaggagccaugacagucaggguaaaauaucugguagcccccuagacaucacagccauaagagggucuuuuucaguuaauuauagaggccuucgacugagccucucagaaauuacugcuacuugcacuggggaggugacgaaugugaguggguguuacucuugcaugacaggcgccaaagucuccaucagacugcauagcagcaaaaauagcacugcccauguaagaugcaaagaggaugagaccgcguuuaguguccuggagggaguucacagcuauacugucagucucagcuuugaccacgcaguggucgaugagcagugccagcugaacuguggggggcaugagagucaagugacucuaaaaggcaaccuuaucuuccuggaugucccaaaauuuguagauggcagcuauaugcagacauaucauaguucugugcccacaggggcuaauaucccaagcccgacagacuggcugaaugccuuguuuggcaaugggcugaguagauggauucugggggugauagggguucugcuggggggauuggcucucuucuucuuaaucaugucuuuguucaaacugggaacaaaacagguauuucgaucaaggacgaagcuggcuuag

SEQ ID NO: 4735 - RNA, 3222 nt, Artificial Sequence
  derived and/or modified CDS sequence (wt) from SFTSV(KAGBH)__KU507560.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuccagggcuacguggggcagcgagguggacgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacagggccguguucugaaucagaagaaaagacuugcaagaccaguggaucaugcaggggggacaugcaguuuugcaagguggcagguugugaacauggggaagaggcaucugaagccaaaugcagaugcucacuagugcacaagccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacuuucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugauaagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggaguggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcucacaaugcccucaggggaagugaggacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucagugaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacugugggggacaugagagucaagugacucugaaaggcaaccucaucuuccuggaugucccaaaauucguagauggcagcuacaugcagacauaucauaguucugugcccacuggagcaaauaucccaagccccacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4736 - RNA, 3222 nt, Artificial Sequence
  derived and/or modified CDS sequence (wt) from SFTSV(KAGBH3)__KU507561.1__GP
augaugaaagucaucugguucuccucucugaucugcuuagucauucaaugcaguggggacacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguuggcuggggcuguggcagugggaagucaaggacugagucaggagagcucugcagcucagacucagggaccaguuccggucuucugcccucaaauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagagacaucugaggccaaaugcagaugcucacuagugcacaagcccggggaaguuguugugucauauggagggaugcgugucagaccaaaaugcuaugguuucuccagaaugauggcaacacuagaggugaacccaccagagcaaaggauuggccaaugcacuggcugccaucuagaaugcauaaaugggggugugaggauaaucacucuaacuagugagcucaagucagcuacugucugugcuucccacuuuuguaguucugccacaaguggcaagaaaagcacggagauucaauuccacucagggucauuaguugggaaaacagcaauucacgucaaaggggcauugguggauggaacugaauucacauuugaaggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggcccagaaggguaaggcacuggauguacucaccugucauccugacuauucuagcaauugggcuugcugagggaugcgaugagaugguccaugcagauucuaaacuuguuuugugcaagcaagggagcggaaauaugaaggaaugugucacaacugggagggcgcuccuuccugcggugaacccagggcaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucgggggaagugaggacauuccaccccaugagcggcaucccuacucaagucuucaagggugugagugugacuuacuugggcucagauauggagguaucuggcuugacugaucugugugaaauagaagagcucaaguccaagaagcuggcauuagcucccugcaaucaggcuggcauggggguuguaggcaagguuggagagauacagugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaacuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuaugcugucagccucaguuuugaccaugcaguggucgaugagcagugccagcugaacuguggggggcaugagagccaagugacucuaaaaggcaaccucaucuuccuggaugucccaaaauucguagaugguagcuacaugcagacauaucauagcucuguacccacaggagcaaauaucccaagcccaacagacuggcugaaugcccuguuuggcaaugggcugaguagguggauucugggggugauagggguucuacuggggggauuagcucucuuuuucuuaaucaugucuuuguucaaacugggaacaaaacagguauuucgaucaaggacgaagcuggcuuag

SEQ ID NO: 4737 - RNA, 3222 nt, Artificial Sequence
  derived and/or modified CDS sequence (wt) from SFTSV(KAGBH4)__KU507562.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgaggugggcgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcugugguagugggaagucaaggacugagucaggagagcucugcagcucagacucagggaccaguuccggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaagccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggugcagccugcggcugcuuuaaugcggccccuucaugcaucuucuggaggaaauggguggagaauccacaugggaucaucuggaaaguaucuccaugugcugcaugggucccaucagcagucauagagcucacaaugcccucaggggaagugaggacauuccaccccaugagcggcaucccuacacaggucuucaagggugugagugugacuuacuugggcucagauauggagguaucuggcuugacugaccugugugaaauagaagagcucaaguccaagaaacuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucuggcagccccuuggacaucacagccauaagagggucuuuuucaguuaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacuguggggggcaugagagucaagugacucugaaaggcaaccucaucuuccuggauguuccaaaauucguagauggcagcuacaugcagacauaucauaguucugugcccacaggagcaaauaucccaagcccuacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4738 - RNA, 3222 nt, Artificial Sequence
  derived and/or modified CDS sequence (wt) from SFTSV(KAGBH5)__KP663738.1__GP
augaugaaagucaucugguucuccucucugaucugcuuagucauucaaugcaguggggacacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuuuauacaagggaaaagucuuuuuugaacggccaacuuuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccagcggaucauguaggggggacaugcaguuuugcaagguggcagguugugaacauggggaagagacaucugaagccaaaugcagaugcucacuagugcacaagcccggggaaguuguugugucauauggagggaugcgugucagaccaaaaugcuaugguuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaggugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcagucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaagggugaggcacuggauguacucaccugucauccuggcuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucgggggaagugaggacauuccaccccaugagcggcaucccuacucaagucuucaagggugugagugugacuuacuugggcucagauauggagguaucuggcuugacugaucugugugaaauagaagagcucaaguccaagaagcuggcauuagcucccugcaaucaggcuggcauggggguuguaggcaagguuggagagauacagugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauuggggggcugagguuugagagaagccaugacagccagggcaaaauaucugguagccccuuggacaucacagccauaagagggucuuuuucaguuaacuauagaggccuucggcugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4739 - RNA, 3222 nt, Artificial Sequence
  derived and/or modified CDS sequence (wt) from SFTSV(KAGBH6)__KP663741.1__GP
augauaaaagucaucugguucuccucucugaucugcuuagucauucaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccauguucugaaucagaagaaaagacuugcaagaccaguggaucaugcaggggggacaugcaguuuugcaagguggcagguugugaacauggggaagaggcaucugaagccaaaugcagaugcucacuagugcacaagccuggggaaguuguugugucauauggagggaugcgugucagaccaaagugcuaugguuucuccaggaugauggcuacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacuuucugucgugaguuucuaaaaaauccucagugcuacccugcaaagaaaugguuguucaucauuauugucauccuccuuggauaugcuggccucaugcuacucaccaauguccuuaaggcaaucgggguuugggggucaugggucauagcuccagugaagcuaauguuugccaucauaaagaaacugauaagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggcuccuucaugcaucuucuggaggaaauggguagagaauccacaugggaucaucuggaaaguaucuccaugugcugcaugggucccaucagcagucauagagcucacaaugcccucaggggaagugaggacauuccacccuaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccuaucagaaauuucugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacuguggggggcaugagagucaaguaacucugaaaggcaaccucaucuuccuggaugucccaaaauucguagauggcagcuacaugcagacauaucauaguucugugcccacaggagcaaauaucccaagcccuacagacuggcugaaugcccuguuuggcaaugggcugaguagguggauucugggggugauagggguucuacuggggggauuggcucucuuuuucuuaaucaugucuuuguucaaacugggaacaaaacaggcauuucgaucaaggacgaagcuggcuuag

SEQ ID NO: 4740 - RNA, 3222 nt, Artificial Sequence
  derived and/or modified CDS sequence (wt) from SFTSV(KAGNH)__KU507550.1__GP
augaugaaagucaucugguucuccucucugaucugcuuagucauucaaugcaguggggauacgggcccaaucauaugcgcagggcccauccacucaaacaagagugccaacauaccccaccugcuuggcuacucugagaagauuugucagauagaucgacugauacauguuucgucauggcugagaaaccauucacaauuccagggcuacguggggcggcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuucgaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagcccaugacacccaucccugaagagacauuucuggagcugaagagcuuuagccagagugaauuuccagacauaugcaaaauugauggcauuguguucaaccagugugagagugagagccuaccucagcccuucgauguugcuuggauggauguuggccacucucauaaaaucaucaugagggagcacaagaccaaauggguacaagagagcucauccaaggauuuugugugcuacaaggaggggacugggccguguucugaaucagaagaaaagacuugcaagaccaguggaucaugcaggggggacaugcaguuuugcaagguggcagguugugaacauggggaagaggcaucugaagccaagugcagaugcucacuagugcacaagcccggggaaguuguugugucauauggagggaugcgugucagaccaaaguguuaugguuucuccagaaugauggcaacacuagaggugaacccaccagagcaaaggauuggccaaugcacuggcugccaucuagaaugcauaaaugggggugugaggcuaaucacucuaacuagugagcucaagucugcuacugucugugcuucccacuuuugcaguucugccacaaguggcaagaaaagcacggaaauucaauuccacucagggucauuaguugggaaaacagcaauacacgucaaaggggcauuaguggauggaacugaauucacauuugagggcaguugcauguucccagacgguugugacgcaguggacugcacauuuugucgugaguuucuaaaaaauccucagugcuacccugcaaagaaaugguuguucaucauuauugucauccuccucggguaugcaggccucaugcuacucaccaauguccuuaaagcaaucggggucugggguucaugggucauagcuccagugaagcuaauguuugccaucauaaagaaacugauuagaucugugagcugcuugauggggaaauugauggauaggggaaggcaagugauccaugaagagauaggggagaauagagagggcaaccaagaugauguuaggaucgagauggcaaggccuagaagggugaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacggcaccagggaguccggacucaaaaugucucaaaauuaaaguuaagaggauuaaccugaaaugcaagaagucaucaucauauuucguuccugacgcucgguccagguguacaucugugaggagaugccgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcauggguuccaucagcagucauagagcuaacaaugcccucaggggaagugagaacauuccaccccaugagcggcaucccuacacaagucuucaagggugugaguguaacuuacuugggcucagauauggagguaucuggcuugacugaccugugugaaauagaagagcucaaauccaagaagcuggcacuagcucccugcaaucaggcaggcauggggguuguaggcaagguuggagagauacagugcaguagcgaggaaagugcccguaccauaaaaaaagauggguguauauggaaugcugaccucgugggcauagagcuacgaguggaugacgcuguaugcuacucuaagaucacuaguguggaggcaguagcaaacuacucugccauacccacuacuauugggggacuaagguuugagagaagccacgacagccaggguaaaauaucugguagccccuuggacaucacagccauaagagggucuuuuucaguuaauuauagaggccuucgacugagccucucagaaaucacugcuacuugcacaggggaggugacaaaugugaguggguguuacucuugcaugacaggcgccaaaaucuccaucaaacugcauagcagcaaaaauagcacugcccauguaagauguaaaggggaugagacugcguucaguguccuggaggguguucauagcuauacugucagucucagcuuugaccaugcgguggucgaugagcagugccagcuaaacugugggggacaugagagucaagugacacuaaaaggcaaccucaucuuccuggaugucccaaaauuuguagauggcagcuacaugcagacauaucauaguucuguacccacaggagcaaauaucccaagcccuacagacuggcugaaugcccuguuuggcaaugggcugaguagguggauucugggggugauagggguucuacuggggggauuggcucucuuuuucuuaaucaugucuuuguucaaacugggaacaaaucagguauuucgaucaaggacgaagcuggcuuag

SEQ ID NO: 4741 - RNA, 3222 nt, Artificial Sequence
  derived and/or modified CDS sequence (wt) from SFTSV(KAGNH4)__KU507551.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagucccugugaugcugauuggcuugggaugcuugucgugaagaaggccaaggggucugauaugauaguuccugggccuucauacaaggggaaagucuuuuuugagcggccaacuuuugauggauacguaggcuggggcuguggcagugggaagucaaggacugagucaggagagcucugcagcucagacucagggaccaguucaggucuucugcccucggauaggguucucuggauaggugauguugcuugccagccuaugacacccaucccugaagagacauuucuggagcugaagaguuuuagccagagugaauucccagacauaugcaaaauugauggcauuguguucaaccagugugagagcgagagccuaccucagcccuuugauguugcuuggauggauguuggccacucucauaaaaucaucaugagggagcauaagaccaaaugggugcaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuaguacauaagcccggggaaguuguugugucauauggagggaugcguaucagaccaaagugcuaugguuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguuccgccacaaguggcaagaaaagcacggagauucaauuccacucugggucauuaguugggaaaacagcaauacacgucaaaggggcauugguggauggaacugaauucacauuugagggcagcugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccucaaggcaaucgggguuugggggucaugggucauagccccagugaagcuaauguuugccaucauaaagaaacugaugagaucugugagcugcuugauggggaaauugauggauagggggaggcaagugauccaugaagaaauaggggagaauagagagggcaaccaagaugauguuaggaucgagauggcaaggccuagaaggguaaggcacuggauguacucaccugucauccugacuauucuagcaauugggcuugcugggggcugcgaugagaugguccaugcagauucuaaacuuguuucgugcaggcaagggagcgggaacaugaaggaaugugucacaacugggagggcgcuccuuccugcggugaacccaggacaagaggcaugucugcacuucacggcaccagggaguccggacucaaaaugucucaaaaucagaguuaagaggauuaaccugaaaugcaagaagucaucuucauauuucguuccugaugcucgguccagguguacaucugugaggagaugccgcugggcaggagacugucagucugggugccccucucauuucacgucuaacuccuuuucugacgauugggcaggcaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagauauggaggugucuggcuugacugaccugugugaaauagaagagcucaaguccaggaaacuggcauuagcucccugcaaucaggcuggcauggggguuguaggcaagguuggagagauacagugcaguagcgaggaaagugcccguaccauaaaaaaagauggguguauuuggaaugcugaccucgugggcauagagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggugccaaagucuccaucaaacugcauagcagcaaaaauagcacugcccauguaagaugcaaaggggaugagacugcguucaguguccuggagggaguucauagcuauacugucagucucagcuuugaccaugcagugguugaugagcagugccagcugaacugugggggacaugagagucaagugacucuaaaaggcaaccucaucuuccuggaugucccaaaauuuguagauggcagcuacaugcagacauaucauaguucugugcccacaggagcaaauaucccaagcccuacagacuggcugaaugcccuguuuggcaaugggcugaguagguggauucugggggugauagggguucuacuggggggauuggcccucuuucucuuaaucaugucuuuguucaaacugggaacaaaacagguauuucgaucaaggacgaagcuggcuuag

SEQ ID NO: 4742 - RNA, 3222 nt, Artificial Sequence
  derived and/or modified CDS sequence (wt) from SFTSV(KAGWH2)__KU507564.1__GP
augaugaaagucaucugguucuccucucugaucugcuuagucauucaaugcgguggggauacgggcccaaucaucugcgcaggacccauccacucaaacaagagugcuggcauaccccaccugcuuggcuacucugagaagauuugucagauagaucggcugauacauguuucgucauggcucagaaaccacucacaauuucagggcuacguagggcagcgagguggacgcucucaggugagcuacuacccggcugaaaauucuuacucaagguggaguggacuucuaagccccugugaugcugauuggcuugggaugcuugucgugaagaaggccaaggggucugauaugauaguuccugggcccucauacaaggggaaagucuuuuuugaacggccaacuuuugauggauacguaggcugggguugugguagugggaagucuaggacugagucaggugagcucugcaguucagacuccgggacuagcucuggucuucugcccucggauaggguucucuggauaggugauguugcuugucagccuaugacacccaucccugaggagacauuucuggagcugaagagcuuuagccaaagugaauucccagauguaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaagugcagaugcucacuugugcacaagcccggggaagucguugugucauauggagggaugcgugucagaccaaagugcuauggauucuccagaaugauggcaacacuggaggugaacccaccagagcaaaggauuggucaaugcacuggcugccaucuagaaugcauaaauggaggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguagcugcauguucccagaugguugugaugcaguggacugcacauucugucgugaguuucuaaaaaauccucagugcuacccugcaaagaaguggcuguucaucauuauugucauccuccuaggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggaucgagauggccaggcccaggaggguaaggcauuggauguacucgccugucauccugacuauucuagcaauugggcuugcugagggcugugaugagaugguccaugcugauucuaaacuuguuucgugcaggcaagggagcggaaauaugaaggaauguguuacaacugggagggcgcuucuuccugcggugaacccugggcaagaggcgugucugcacuucacggcaccuggaaguccggacucaaaaugucucaaaauuaagguuaagaggaucaaccuaaaauguaagaagucaucaucauauuuuguuccugaugcccgguccaggugcacaucagugaggagaugucguugggcaggggacugccagucugggugccccccucauuucacauccaacuccuuuucugaugauugggcagguaagauggacagggcuggucuaggauucaguggcugcucugauggguguggaggagcagccugcgguugcuuuaaugcggccccuucaugcauuuucuggaggaaauggguagagaauccacaugggaucaucuggaaaguaucuccaugugccgcaugggucccaucagcaguuauagagcuaacaaugcccucaggggaggugaggacauuccaccccaugagcggaauccccacacaagucuucaagggugugaguguaacuuacuugggcucagacauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaagaaagaugggugcauauggaaugcugaccucguggguauagagcuacgaguggaugacgcugugugcuacucuaagaucacuaguguggaggcaguugcaaacuacuccgccauacccaccacuauuggggggcugagguuugagagaagccaugacagccaggguaaaauaucuggaagcccccuggacaucacagcuauaagaggauccuuuucuguuaauuauagaggccuucgacugagucucucagaaauuacugcuacuugcacaggggaagugacaaaugugaguggguguuauucuuguaugacaggcgccaaagucucuaucaaauugcauagcagcaaaaauagcacugcccauguaagaugcaaaggggaugagacugcauucagugucuuggagggaguccauagcuacucugucagucuaaguuuugaucaugcagucgucgaugagcagugccaacugaacugugggggacaugagagucaagugacucuaagaggcaaccucaucuuccuggaugucccgaaauuuguggauggcagcuacaugcagacauaucauaguacugugcccacaggggcaaauaucccaagcccuacagauuggcugaaugccuuguuuggcaaugggcugaguagguggauccuuggggugauagggguccuacuggggggguuggcucucuuuuucuugaucaugucuuuguucaagcugggaacaaaacagguauuucgaucgaggacgaagcuggcuuag

SEQ ID NO: 4743 - RNA, 3222 nt, Artificial Sequence
  derived and/or modified CDS sequence (wt) from SFTSV(KAGWH3)__KP663735.1__GP
augaugaaagucaucugguucuccucucugaucugcuuagucauucaaugcaguggggauacgggcccaaucauaugcgcagggcccauccacucaaacaagagugccaacauaccccaucugcuugguuacucugaaaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuuaucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaagccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguagcucugccacaaguggcaagaaaagcacggagauucaauuccacucagggucauuaguugggaaaacagcaauacaugucaaaggggcuuugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugaguugcuugauggggaaauugauggauaggggaaggcaagugauccaugaagaaauaggagaggucagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacggcaccagggagcccggacucaaaaugucucaaaaucaaaguuaagaggauuaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggagaaaauggguagagaauccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagacauggagguaucuggcuugacugaccugugugaaauagaagagcucaaguccaagaagcuggcauuagcucccugcaaucaggcuggcauggggguuguaggcaagguuggagagauacaguguaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuaucgggggacugagguuugagagaagccaugacagucaggguaaaauaucugguagccccuuggacaucacagccauaagagggucuuuuucaguuaauuauagaggccuucgacugagccuaucagaaauuacugcuaccugcacaggggaggugacaaaugugaguggguguuacucuugcaugacaggcgccaaagucuccaucaaacugcauagcagcaaaaauagcacugcgcauguaaggugcaaaggggaugagacugcguucaguguccuggagggaguucauagcuauacugucagccucaguuuugaccaugcaguggucgaugagcagugccagcuaaacuguggggggcaugagagucaagugacucugaaaggcaaccucaucuuccuggaugucccaaaauucguagauggcagcuacaugcagacauaucauaguucugugcccacaggagcaaauaucccaagcccuacagacuggcugaaugcccuguuuggcaauggguugaguagguggauucugggggugauagggguucuacuggggggauuggcucucuucuucuuaaucaugucuuuguucagacugggaacaaaacagguauuucgaucaaggacgaagcuggcuuag

SEQ ID NO: 4744 - RNA, 3222 nt, Artificial Sequence
  derived and/or modified CDS sequence (wt) from SFTSV(KAICH)__KU507565.1__GP
augaugaaagucaucugguucuccucucugaucugcuuagucauucaaugcgguggggacacgagcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuuguugugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucaacccuuugauguugcguggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggagaagucguugugucauauggagggaugcguguaagaccaaagugcuaugguuucuccagaaugauggcaacacuggaggugaaccaaccagagcaaaggauuggucaaugcacuggcugccaucuagaaugcauaagugggggugugaggcugaucacucuaaccagugagcucaagucagcuacugucugcgcuucucacuuuuguaguucugccacaagugguaagaaaagcacggagauucaauuccacucaggaucauugguugggaaaacagcaauccacgucaaaggggcacugguagauggaacugaauucacauuugaggguaguugcauguuuccagaugguugugaugcaguggacugcacauucugucgugaguuucuaaaaaauccucagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaagcuaaugagagcugugagcugccugauggggaaauugauggauaggggaaggcaagugauccaugaggaaauaggggagaauagagagggcaaccaagaugauguuaggaucgagauggccagacccaggaggguaaggcauuggauguacucgccugucauccugacuauucuagcaauagggcuugcugagggcugugaugaaaugguccaugcugauucaaaacuuguuucgugcaggcaagggagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaagaagucaucaucauauuuuguuccugaugcccgguccagguguacaucagugaggagaugucguugggcaggagacugccagucugggugccccccucauuucacaucuaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaaguaucuccaugugccgcaugggucccaucagcagucauagagcuaacaaugcccucaggggaggugaggacauuccaccccaugagcggaauccccacacaagucuucaagggugugaguguaacuuacuugggcucugauauggaggugucaggcuugacugaccugugugagauggaagagcucaagucaaaaaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacgaguggaugacgcugugugcuacucuaagaucacuaguguggaggcaguuacaaacuacuccgccauacccaccacuauuggggggcugagguuugagagaagccaugacagccaggguaaaauaucugguagcccccuggacaucacagcuauaagaggaucuuuuucugucaauuacagaggccuucgacugagucucucagaaauuacugcuacuuguacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagaguaaagugacucuaagaggcaaccucaucuuccuggaugucccgaaauuuguggauggcagcuacaugcagacauaucauaguacagugcccacaggggcaaauaucccaagcccuacagauuggcuaaaugccuuguuuggcaaugggcugaguaggugguuucugggaguaauagggguccuacuggggggauuggcucucuuuuucuugaucaugucuuuguucaagcugggaacaaaacaaguauuucgaucgaggucgaagcuggcuuag

SEQ ID NO: 4745 - RNA, 3222 nt, Artificial Sequence
  derived and/or modified CDS sequence (wt) from SFTSV(KAJJH)__KU507566.1__GP
augaugaaagucaucugguucuccucucugaucugcuuagucauucaaugcaguggggacacgggcccaaucauaugcgcaggacccauccacucaaacaagagugccaacauaccccaccugcuugguuacucugagaagauuugccagauagaucggcugauacauguuucgucauggcugagaaaccauucacaauuucagggcuacguggggcagcgagguggacgcucucagguaaguuacuacccagcugaaaacucuuacucaagguggaguggacuucuaagccccugugaugcugauuggcuugggaugcuugucgugaagaaggccaaggggucugauaugauagucccugggccuucauacaaggggaaagucuuuuuugaacguccaacuuuugauggauacgugggcuggggcuguggcagugggaagucaaggacagagucaggugagcucuguagcucagacucagggaccaguucuggucuucugcccuccaauaggguucucuggauaggugauguugcuugccagcccaugacacccaucccugaggagacauuucuagagcugaagaguuucagccagagugaauucccagacauaugcaaaauugauggcauuguguucaaccagugugagagugagagccuaccucagcccuuugaugucgcauggauggauguaggucacucucauaaaaucaucaugagggagcacaagaccaaauggguacaagagagcucauccaaggauuuugugugcuacaaggaagggacugggccguguucugaaucagaagaaaggacuugcaagaccaguggaucaugcaggggggacaugcaguuuugcaaggucgcagguugugaacauggggaagaggcaucugaagccaaguguagaugcucccuagugcacaagcccggggaaguuguuguaucauauggagggaugcgugucagaccaaaguguuaugguuucuccagaaugauggcaacacuagaggugaacccaccagagcaaagaauuggccaaugcacuggcugccauauagaaugcauaaaugggggugugaggcuaaucacucuaacuagugagcucaagucagcaacugucugugcuucccacuuuuguaguucugccacaaguggcaagaaaagcacggagauucaauuccacucaggaucauuaguugggaaagcugcaauacaugucaaaggggcuuugguggauggaacugaauucacauuugagggcaguugcauguuuccagaugguugugacgcuguggacugcacauucugucgugaguuccuaaaaaauccucagugcuacccugcaaagaaaugguuguucauuauuauugucauccuccuuggauaugcaggccucaugcuacucaccaauguccuuaaggcaaucgggguuuggggaucaugggucauagcuccagugaagcuaauguuugccaucauaaagaaacuuaugagaucugugagcugcuugauggggaaauugauggauaggggaaggcaagugauccaugaagaaauaggggagaauagagagggcaaccaagaugauguuaggaucgagauggcaagacccagaagggugaggcauuggauguacucaccugucauccugacuauucuagcaauugggcucgcugagggcugcgaugagaugguccaugcagauucuaaacuugugucgugcaggcaagggggcggaaauaugaaggaaugugucacaacuggaagggcgcuccuuccugcagugaacccaggacaagaggcaugucugcacuucacggcuccugggaguccggacucaaaaugucucaaaaucaagguuaagaggaucaaccuaaaauguaagaagucaucaucauauuuuguuccugaugcucgguccagguguacaucuguaaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuuuuggagaaaauggguagagaauccacaugggaucaucuggaaaguauccccaugugcugcaugggucccuucagcagucauagagcuaacaaugcccucgggggaagugaggacauuccaccccaugagcggcauccccacucaagucuucaagggugugagugugacuuacuuaggcucagauauggaggugucuggcuugaccgaccugugugagauagaagaacucaaguccaagaagcuggcauuagcucccugcaaucaggcuggcaugggggucguaggcaagguuggagagauacagugcaguagcgaggaaagcgcccguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagcuauaagaggguccuuuucaguuaauuauagaggccuucgacugagccucucagaaauuacugcuacuugcacaggagaggugacgaaugugaguggguguuacucuugcaugacaggcgccaaagucuccaucaaacugcauagcagcaaaaauagcacugcccaugugagaugcaaaggggaugagaccgcauucaguguccuggagggaguucauagcuauacugucagucucagcuuugaucaugcaguggucgaugagcagugccaacugaacuguggagggcaugagagucaagugacucuaaagggcaaccucaucuuccuggaugucccaaaauuuguagauggcagcuauaugcagacauaucauaguucugugcccacaggggcuaauaucccaagcccaacagacuggcugaaugccuuguuuggcaaugggcugaguagguggauucugggggugauagggguucuacuggggggauuggcucucuucuucuuaaucaugucuuuguucaaacuggggacaaaacagguauuucgaucaaggacaaagcuggcuuag

SEQ ID NO: 4746 - RNA, 3222 nt, Artificial Sequence
  derived and/or modified CDS sequence (wt) from SFTSV(KAJNH2)__KU507552.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugacuggcuugggaugcuugucuugaagaaggccaaggagucugauaugauaguuccugggccuucauacaaggggaaagucuuuuuugaacggccaacuuuugauggauacgugggcuggggcuguggcagugggaagucaaggacagagucaggugagcucugcagcucagacucagggaccaguucuggucuucugcccucagauagaguucucuggauaggugauguugcuugccagccuaugacaccuaucccugaggagacauuucuggaacugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagcuaaguguagaugcucacuagugcacaagcccggggaaguuguugugucauauggagggaugcgugucaggccaaaguguuaugguuucuccagaaugauggcaacacuggaggugaacccaccagagcaaaggauuggccaaugcacuggcugccaucuagaaugcauaaauggggguguaaggcuaaucacucuaacuagugagcucaagucagcuacugucugugccucccacuuuuguaguucugccacaaguggcaagaaaagcacggagauucaauuccacucagggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcgaagaaaugguuguucauuauuauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccgagaugauguuaggaucgagauggcaagacccagaagggugaggcauuggauguacucuccugucauccugacuauucuagcaauugggcuugcugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaaugcaagaagucaucaucauauuuuguuccugaugcucgguccagguguacaucugugaggagaugucgcugggcaggagacugccagucugggugccccucucauuucacguccaacuccuucucugaugauugggcagguaaaauggacagggcuggucuaggguucagugggugcucugauggguguggaggagcggccugcggcugcuuuaaugcagccccuucaugcaucuuuuggaggaaauggguagagaauccacaugggaucaucuggaaaguaucuccaugugcugcaugggucccaucagcagucauagagcuaacaaugcccucgggggaagugaggacauuccaccccaugagcggcauccccacacaagucuucaagggugugagugugacuuacuuaggcucagauauggaggugucuggcuugacugaccugugugagauagaagagcucaaguccaagaagcuggcauuagcucccugcaaucaggcuggcauggggguugugggcaagguuggagagauacagugcaguagcgaggaaagcgcucguaccauaaagaaagauggguguauauggaaugcugaccuugugggcauagaguuacgaguggaugaugcugugugcuacucuaagaucacuaguguggaggcaguugcaaacuacucugccauacccaccacuauuggggggcugagguuugagagaagccaugacagccaggguaaaauaucugguagccccuuagacaucacagccauaagagggucuuuuucaguuaauuauagaggccuucgacugagccucucagaaaucacugcuacuugcacaggagaggugacgaaugugaguggauguuauucuugcaugacaggugccaaagucuccaucaagcugcauagcagcaaaaauagcacugcccaugugaggugcaaaggggaugagaccgcguucaguguccuggaagggguucauagcuauacugucagucucagcuuugaccaugcaguggucgaugagcagugccagcugaacuguggggggcaugagagucaagugacucuaaaaggcaaccuaaucuuccuggaugucccaaaauuuguugauggcagcuauaugcagacauaucauaguucugugcccacaggggcuaauaucccaagcccaacagacuggcugaaugccuuguuuggcaaugggcugaguagguggauucugggggugauagggguucuacuggggggauuggcccucuucuucuuaaucaugucuuuguucaaacugggaacaaaacagguauuucgaucaagggcgaagcuggcuuag

SEQ ID NO: 4747 - RNA, 3222 nt, Artificial Sequence
  derived and/or modified CDS sequence (wt) from SFTSV(ZL13-32)__KU361342.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcaguggaaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucaucauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauacccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4748 - RNA, 3222 nt, Artificial Sequence
  derived and/or modified CDS sequence (wt) from SFTSV(AHL/China/2011)__JQ670930.1__GP
augaugaaagucaucugguucuccucucugaucugccuagucauucaaugcaguggggauacgggcccaaucaucugcgcaggacccauccacucaaauaagagugcugacauaccccaccugcuggguuacucugagaagauuugucagauagaucggcugauacauguuucgucauggcucagaaaccacucacaauuucagggcuacguagggcagcgagguggacgcucucaggugagcuacuacccagcugaaaauucuuacucaagguggaguggacuucuaagccccugugaugcugauuggcuagggaugcuugucgugaagaaggccaaggggucugauaugauaguuccuggaccuucauauaagggaaaagucuuuuuugaacggccaacuuuugauggauacguaggcuggggcuguggcagugggaagucuaggacugagucaggugagcucuguaguucagacucagggacuaguucuggucuucugcccucggauaggguucucuggauaggugauguugcuugucagccuaugacacccaucccugaggagacauuucuggagcugaagagcuuuagccaaagugaauucccagacauaugcaaaauugauggaauuguguucaaccagugugagggugagagucuaccucagcccuuugauguugcauggauggauguuggucacucucauaaaaucaucaugagggagcacaaaaccaaauggguucaagagagcucaucuaaggauuuugugugcuacaaggaggggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcguaucagaccaaagugcuaugguuucuccagaaugauggcaacacuggaggugaacccacccgagcaaaggauuggucaaugcacaggcugccaucuagaaugcauaaaugggggugugaggcuaaucacucuaaccagugagcucaagucagcuacugucugcgcaucucacuuuuguaguucugccacaaguggcaagaaaaacacggagauucaauuccacucaggaucgcugguugggaaaacagcaauacaugucaagggggcauugguagauggaacugacuucacuuuugagggcagcugcauguucccagauggaugugaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauugggguuuggggaucaugggucauagcuccagugaagcuaauguuugccaucaugaagaaacuaaugagaucugugagcugcuugauggggaaauugauggacaggggaaggcaagugauccaugaggaaauaggggagaauagagagggcaaccaagaugauguuaggaucgagauggcaagacccaggaggguaaggcauuggauguacucaccugucauccugacuauucuagcaacagggcuugcugagggcugugaugagaugguccaugcugauucuaaacuuguuucaugcaggcaagggagcggaaauaugaaggaaugugucacaacugggagggcgcuucuuccugcagugaacccaggacaagaggcaugucugcacuucacggcaccugggaguccggacucaaaaugucucaagaucaagguuaagaggaucaaccuaaaaugcaaaaagucaucaucauauuuuguuccugaugcucgguccagguguacaucagugaggagaugucguugggcaggagacugccagucugggugccccccucauuucacauccaauuccuuuucugaugauugggcagguaagauggacagggcuggucugggauucaguggcugcucugauggauguggaggagcagccugcggcugcuucaaugcggccccuucaugcaucuucuggaggaaauggguagagaauccacaugggaucaucuggaaagugucuccaugugccgcaugggucccaucagcagucauagaacuaacaaugcccucaggggaggugaggacauuccaccccaugagcggcauccccacacaagucuucaagggugugaguguaacuuacuugggcucagauauggaggugucuggcuugacugaccugugugagauagaagagcucaagucgaagaagcuggcauuagcucccugcaaucaggcuggcauggggguuguaggcaagguuggagagauacagugcaguagcgaggaaagugcccguaccauaaaaaaagaugggugcauauggaaugcugaccucguggguauagaguuacgaguggaugaugcugugugcuacucuaagaucacuaguguggaggcaguugcaaacuacuccgccauacccaccacuauuggggggcugagguuugagagaagccaugacagccagggcaaaauaucugguagcccccuagacaucacagccauaagagggucuuuuucugucaauuauagaggccuucggcugagucucucagaaauuacugcuacuuguacaggggaagugacaaaugugaguggguguuauucuugcaugacaggggccaaagucuccgucaaauugcauagcagcaaaaauaguacugcccacguaagaugcaaaggggaugagacugcauucagugucuuggagggaguccauagcuacacugucagucucagcuuugaucaugcaguagucgaugagcagugccaacugaacugugggggacaugagagucaagugacucuaaaaggcaaccucaucuucuuggaugucccaaaauuuguugaugguagcuacaugcagacauaucauaguacugugcccacaggggcaaauaucccaagccccacagauuggcugaaugccuuguuuggcaaugggcugagcagguggauucugggggugauagggguccuacuggggggauuggcucucuuuuucuugaucaugucuuuguucaagcugggaacaaaacagguauuucgaucaaggacgaagcuggcuuag

SEQ ID NO: 4749 - RNA, 3222 nt, Artificial Sequence
  derived and/or modified CDS sequence (wt) from SFTSV(AH-YTY/China/05/2012)__KR017849.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacaugucucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcugggguuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucuguaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccugagcaaaggauuggucaaugcacuggcugccaucuggaaugcauaaaugggggugugaggcuaauaacucuaaccagugagcucaagucagcuacugucugugcuucccacuuuuguaguucugccacaaguggcaagaaaagcacggagauucaauuccacucaggaucauugguugggaaaacagcaauacacgucaaaggggcauugguagauggaacagaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagagcugugagcugcuugauggggaaauugauggauaggggaaggcaagugauccaugaggagauaggggagaauagagagggcaaccaggaugauguuaggauugagauggcaagaccuagaaggguaaggcauuggauguacucaccugucauccugacuauuuuagcaauagggcuugcugagagcugugaugagaugguccaugcugauucuaagcuugucucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcugguuuaggguucaguggcugcucugauggguguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuggcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcucauguaagaugcaaaggggaugagacugcauucagugucuuggaggggguccauagcuacacugucagucucaguuuugaucaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucugcuugggggguuggcucucuuuuuuaugauuaugucuuuguucaagcugggaacaaaacagguauuucgaucaaggacgaagcuggcuuag

SEQ ID NO: 4750 - RNA, 3222 nt, Artificial Sequence
  derived and/or modified CDS sequence (wt) from SFTSV(AHZ/China/2011)__JQ670931.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggauacuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcuaaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucuguaagauagcagguugugaacauggggaagaggcaucugaagccaaguguagaugcucacuugugcacaagcccggagaagucguuguaucauauggagggaugcgugucagaccaaagugcuaugguuucuccagaaugauggcaacacuggaggugaaccaaccugagcaaaggauuggucaaugcacuggcugccaucuggaaugcauaaaugggggugugaggcuaauaacucuaaccagugagcucaagucagcuaccgucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucaucauugucauccuacuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagaggguaaccaagaugauguuaggauugagauggcaaggcccagaagggugaggcauuggauguacucaccugucauccugacuauuuuagcaauaggacuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggagcccggacucaaaaugucucaaaauuaagguuaaguggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaucaaugcccucaggggaggugaggacauuccaccccaugaguggcauccccacacaagucuucaagggugugagugugacuuacuugggcucagauauggaggugucuggcuugacuggccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaaucaguugcaaacuacucugccauacccaccacuauuggggggcugagguuugagagaagccaugacagccagggcaaaauaucugguagcccccuggacaucacagcuauaagaggaucuuuuucugucaauuauagaggccuucgacugagccucucagaaauuacugcuaccugcacaggggaggugacaaaugugaguggauguuauucuugcaugacaggcgccaaagucucuauuaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggguugauagggguucugcuugggggguuggcucucuuuuucaugauuaugucuuuguucaagcugggaacaaaacagguauuucgaucaaggacgaagcuggcuuag

SEQ ID NO: 4751 - RNA, 3222 nt, Artificial Sequence
  derived and/or modified CDS sequence (wt) from SFTSV(DS02/CHN/2013)__KR698332.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaaucuucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccaggagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauaccaaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcuguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucugcuggggggauuagcccucuucuucuuaaucaugucuuuguucaaacugggaacaaaacagguauuucgaucaaggacgaagcuggcuuag

SEQ ID NO: 4752 - RNA, 3222 nt, Artificial Sequence
  derived and/or modified CDS sequence (wt) from SFTSV(DS03/CHN/2013)__KR698333.1__GP
augaugaaagucaucugguucuccucucugaucuacuuaguuauucaaugcaguggggauucgggcccaaucauaugugcagggcccauccacucaaacaagagugccaacauaccccaccugcuugguuacucugagaagauuugucagauagaucgacugauacauguuucgucauggcugagaaaccauucacaauuucagggcuacguggggcagcgagguggacgcucucaggugagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugaugucgcuugccagccuaugacacccaucccugaggagacauuucuggagcugaagaguuuuagccagagugaauucccagacauauguaaaauugauggcauuguguucaaccagugugagagagagagucuaccucagcccuuugauguugcauggauggauguuggccacucucauaaaauuaucaugagggagcacaagaccaaaugggugcaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagccuggggaaguugucgugucauauggagggaugcgagucagaccaaaguguuaugguuucuccagaaugauggcaacacuagaggugaacccaccagagcagaggauuggccaauguacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggagaacagcaauacacgucaaaggggcacugguggauggaacugaauucacauuugaggguaguugcauguucccagaugguugugacgcaguggacugcacauucugucgugaguuccuaaaaaauccucaaugcuacccugcaaagaaaugguuguucaucauuauugucauccuccuuggauaugcaggccucaugcugcucaccaauguccuuaaggcaaucgggguuuggggaucaugggucauagcuccagugaagcuaauguuugccaucauaaagaaacugaugagaucugugagcugccugaugggaaaauugauggauaggggaaggcaagugauccaugaagaaauaggggagaauagagagggcaaccaagaugauauuaggaucgagauggcaagacccagaaggguaaggcauuggauguacucaccugucauccugacuauucuagcaguugggcuugcugagggcugcgaugagaugguccaugcagauucuaagcuuguuucgugcaagcaggggagcggaaauaugaaggaaugugucacaacagggagggcgcuccuuccugcggugaacccaggacaagaggcaugccugcacuucacggcaccugggaguccggacucaaaaugucucaaaauuaagguuaagaggauuaaccuaaaauguaagaagucaucaucauauuuuguuccugaugcucggucaaggugcacaucugugaggagaugucgcugggcaggggacugucagucugggugccccucucauuucacgucuaacuccuuuucugaugauugggcagguaaaauggacagggcuggccuaggauucagugggugcucugauggauguggaggagcagcuuguggcugcuuuaaugcggccccuucaugcauuuucuggaggaaauggguagagaauccacaugggaucaucuggaaaguaucucccugugcugcaugggucccaucagcagucauagagcuaacaaugcccucaggggaagugaggacauuccaccccaugagcggcaucccaacacaagucuucaagggugugagugugacuuacuuaggcucugauauggaggugucuggcuugacugaccugugugagauagaagagcuaaaguccaagaagcuggcauuagcucccugcaaccaggcuggcauggggguuguagguaaggucggagagauacagugcagcagugaggaaagugcccguaccauaaaaaaagauggguguauauggaaugcugaccuugugggcauagagcuacgaguggaugaugcugugugcuacucuaagaucacuaguguggaggcaguugcaaacuacucugccauacccaccacuauuggggggcugagguuugagagaagccaugacagccagggcaaaauaucugguagcccccuggacaucacagccauaagagggucuuuuucaguuaauuacagaggccuucgacugagccucucagaaauuacugccacuugcacaggggaggugacaaaugugaguggguguuacucuugcaugacaggcgccaaagucuccaucaagcugcacagcagcaaaaauagcacugcccaugugaggugcaaaggggaugagacugcguucaguguccuggagggaguucauagcuauacuguuagucucagcuuugaccaugcaguggucgaugagcagugccagcugaacuguggggggcaugagagucaagugacucuaaaaggcaaccucaucuuccuggaugucccaaaauuuguagauggcagcuacaugcagacauaucauaguucuguacccacaggggcaaauaucccaagcccuacagacuggcugaaugcccuguuuggcaaugggcugaguagguggauucugggggugauagggguucuacuggggggauuggcucucuuuuucuuaaucaugucuuuguucaaauugggaacaaaacagguauuucgaucaaggacgaagcuggcuuag

SEQ ID NO: 4753 - RNA, 3222 nt, Artificial Sequence
  derived and/or modified CDS sequence (wt) from SFTSV(DS04/CHN/2013)__KR698334.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccgccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguuguaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuacacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4754 - RNA, 3222 nt, Artificial Sequence
  derived and/or modified CDS sequence (wt) from SFTSV(DS05/CHN/2013)__KR698335.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaagugucaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcuaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaaugcaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggaaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcuuagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4755 - RNA, 3222 nt, Artificial Sequence
  derived and/or modified CDS sequence (wt) from SFTSV(HB154/China/2011)__JQ733560.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugacaugauaguuccugggccuucauacaaggggaaagucuuuuuugaacgaccaacuuuugauggauacguaggcuggggcuguggcagugggaagucuaggacugagucaggagagcucugcaguucagacucagggacaaguucuggucuucugcccucggauaggguucucuggauaggugauguugcuugucaaccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcaggcugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugaucaaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucgugggcauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugaaagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuccuugaucauguuuuugcucaagcugggaacaaaacagguauuucgaucgaggacgaagcuggcuuag

SEQ ID NO: 4756 - RNA, 3222 nt, Artificial Sequence
  derived and/or modified CDS sequence (wt) from SFTSV(HB155/China/2011)__JQ733563.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgaggugggcgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaaugggugcaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccuccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagccauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaaccgggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggaugugguggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauaccaaccacuauuggggggcugagguuugagagaagccaugacagccaggguaaaauaucugguagcccccuggacaucacagcuauaagaggaucauuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaagauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4757 - RNA, 3222 nt, Artificial Sequence
  derived and/or modified CDS sequence (wt) from SFTSV(HB156/China/2011)__JQ733566.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugacaugauaguuccugggccuucauacaaggggaaagucuuuuuugaacgaccaacuuuugauggauacguaggcuggggcuguggcagugggaagucuaggacugagucaggagagcucugcaguucagacucagggacaaguucuggucuucugcccucggauaggguucucuggauaggugauguugcuugucaaccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcaggcugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuccuuccugcggugaacccaggacaagaggcaugucugcacuucacagcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgcugcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguugugggcaagguuggagagauacagugcaguagcgaggagagugcccguaccauaaaaaaagaugggugcauauggaaugcagaccucgugggcauagagcuacgaguggaugacgcugugugcuacucuaagauuacuaguguggaggcaguugcaaacuacucugccauacccaccacuauuggggggcugagguuugagagaauccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4758 - RNA, 3222 nt, Artificial Sequence
  derived and/or modified CDS sequence (wt) from SFTSV(HB2014-04)__KR080475.1__GP
augaugaaagucaucugguuccccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaugugagcuacuacccagcugaaaauucuuacucaagguggagugggcuucuaagccccugugaugcugauuggcuugggaugcuugucgugaagaaggccaaggggucugauaugauagucccugggccuucauacaagggaaaagucuuuuuugagaggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcuaaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuccuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugacuuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaauuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggucgaagcuggcuuag

SEQ ID NO: 4759 - RNA, 3222 nt, Artificial Sequence
  derived and/or modified CDS sequence (wt) from SFTSV(HNXH)__KT254590.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgaggcggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucggggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcauccgaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugcccucauaaagaaacugaugagagcugugagcugccugauggggaaauugauggauaggggaaggcaagugauccaugaggaaauaggggaaaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaauguguuacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggguucaguggcugcucugauggauguggaggagcagccugcgguugcuuuaaugcggccccuucaugcauuuucuggaggaaauggguagagaauccacaugggaucaucuggaaaguauccccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuaguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugccacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggagcaaauaucccuagcccuacagauuggcuaaaugccuuguuuggcaaugggcugaguagguggauucugggggugacagggguccuacuggggggauuggcucucuuuuucuugaucaugucuuuguuuaagcugggaacaaaacagauauuucgaucgaggacaaagcuggcuuag

SEQ ID NO: 4760 - RNA, 3222 nt, Artificial Sequence
  derived and/or modified CDS sequence (wt) from SFTSV(JS2012-goat01)__KC473538.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaaaaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauagggggaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaacaugaaggaaugugucacaacugggagggcgcuucuuccugcggugaacccaggucaagaggcaugucugcacuucacggcaccugggaguccggacucaaaaugccucaaaauaaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaacgcagccccuucaugcaucuucuggaggaaauggguagaaaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcugaccuugugggcauagagcuacgaguagaugacgcugugugcuacucuaagaucacuaguguggaagcaguugcaaacuacucugccauacccaccacuauuggggggcugagguuugagagaagccuugacagccaggguaaaauaucugguagcccccuagacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggagggaguccauagcuacacugucagucucaguuuugaccaugcaguagucgaugagcagugccaacugaacuguggggggcaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuuuaugauuaugucuuuguucaagcugggaacaaaacagguauuucgaucaaggacaaagcuggcuuag

SEQ ID NO: 4761 - RNA, 3222 nt, Artificial Sequence
  derived and/or modified CDS sequence (wt) from SFTSV(JS2012-tick01)__KC473541.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucggauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaaaaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauagggggaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaacaugaaggaaugugucacaacugggagggcgcuucuuccugcggugaacccaggucaagaggcaugucugcacuucacggcaccugggaguccggacucaaaaugccucaaaauaaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaacgcagccccuucaugcaucuucuggaggaaauggguagaaaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuagacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggagggaguccauagcuacacugucagucucaguuuugaccaugcaguagucgaugagcagugccaacugaacuguggggggcaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuuuaugauuaugucuuuguucaagcugggaacaaaacagguauuucgaucaaggacaaagcuggcuuag

SEQ ID NO: 4762 - RNA, 3222 nt, Artificial Sequence
  derived and/or modified CDS sequence (wt) from SFTSV(LN2012-14)__KF887436.1__GP
augaugaaagucaucugguucuccucucugaucugcuuugucauucaaugcaguggggauucaggcccaaucaucugcgcaggacccauccacucaaacaagagugcugacauaccucaccugcuggguuauucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguccccgggccuucauacaagggaaaagucuuuuuugagcggccaacuuuugauggauauguaggcuggggcuguggcagugggaagucuaggacagagucaggagagcucugcaguucagacucagggacuagcucuggucuucugcccucggauaggguucucuggauaggugauguugcuugucagccaaugacacccaucccugaggagacauuucuggagcugaagaguuuuagccaaagugaauuuccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggagacaugcaguucugcaagguggcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguggauggaacugaauucacauuugaggguaguugcauguucccagaugguugugaugcgguggacugcacuuucugucgugaguuucuaaaaaauccccagugcuacccugcuaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuuggaucgagauggcaagacccagaaggguaagguauuggauguacucaccugucauccugacuauuuuggcaguagggcuugcugagagcugugaugagaugguccaugcugauucuaagcuuguuucaugcaggcaagggagcggaaauaugaaggaaugugucacaacugggagggcgcuucuuccugcggugaacccaggucaagaggcgugucugcacuucacggcaccugggaguccggacucaaaaugucucaaaauuaggguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauuggguagguaagauggacagggcuggucuaggauucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugaguguaacuuacuugggcucagauauggaggugucuggcuugacugaccuaugugagauagaggagcucaaguccaagaagcuggcauuagcucccugcaaccaggcuggcauggggguugugggcaagguuggagagauacagugcaguagcgaggaaagugcccguaccauaaaaaaagaugggugcauauggaaugcagaccucgugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagccauaagaggaucuuuuucuguuaauuauagaggccuucgacugagucucucagaaauuacugcuaccugcacaggggaggugacaaaugugaguggguguuauucuugcaugacaggcgccaaagucucuaucaaacugcauagcaacaaaaauagcacugcccauguaagaugcaaaggggaugagacugcauucaguguuuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucacagcacugugcccacaggggcaaauaucccaagcccuacagacuggcugaaugccuuguuuggcaaugggcugaguagguggauccugggggugauagggguucugcuugggggauuggcucucuuuuucaugaucaugucuuuguucaaguugggaacaaaacagguauuucgaucaaggacgaagcuggcuuag

SEQ ID NO: 4763 - RNA, 3222 nt, Artificial Sequence
  derived and/or modified CDS sequence (wt) from SFTSV(LN2012-34)__KF887437.1__GP
augaugaaagucaucugguucuucucucugaucugcuuugucauucaaugcaguggggauucaggcccaaucaucugcgcaggacccauccacucaaacaagagugcugacauaccucaccugcuggguuauucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucugagccccugugaugcugauuggcuugggaugcuugucgugaagaaggccaaggggucugauaugauagucccugggccuucauacaagggaaaagucuuuuuugaacggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucauguaggggagacaugcaguucugcaagguggcagguugugaacauggggaagaggcaucugaagccaagugcagaugcucacuugugcacaagcccggagaagucguugugucauauggagggaugcguaucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacaugucaaaggggcauugguggauggaacugaauucacauuugaggguaguugcauguucccagaugguugugaugcgguggacugcacuuucugucgugaguuucuaaaaaauccccagugcuacccugcuaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggaucgagauggcaagacccagaaggguaaggcauuggauguacucaccugucauccugaccauuuuagcaauagggcuugcugagagcugugaugagaugguccaugcugauucuaagcuuguuucaugcaggcaagggagcggaaaugugaaggaaugugucacaacugggagggcgcuucuuccugcggugaacccaggucaagaggcgugucugcacuucacggcaccugggaguccggacucaaaaugucucaaaauuaggguuaagaggaucaaccuaaaauguaagaagucaucaucauauuuugucccugaugcccgguccagauguacaucagugaggagaugucguugggcuggagacugccagucugggugccccccucauuucacauccaauuccuuuucugaugauugggcagguaagauggacagggcuggucuaggauucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugagaacauuccaccccaugaguggcauccccacacaagucuucaagggugugagcauaacuuacuugggcucagauauggaggugucuggcuugacugaccuaugugagauagaggagcucaagucuaagaagcuggcauuagcucccugcaaccaggcuggcauggggguuguaggcaagguuggagagauacagugcaguagcgaggaaagugcccguaccauaaaaaaagaugggugcauauggaaugcagaccucgugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagccauaagagggucuuuuucuguuaauuauagaggccuucgacugagucucucagaaauuacugcaaccugcacaggggaggugacaaaugugaguggguguuauucuugcaugacaggcgccaaagucucuaucaaacugcauagcaacaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucacagcacugugcccacaggggcaaauaucccaagcccuacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacgaagcuggcuuag

SEQ ID NO: 4764 - RNA, 3222 nt, Artificial Sequence
  derived and/or modified CDS sequence (wt) from SFTSV(LN2012-41)__KF887438.1__GP
augaugaaagucaucugguucuccucucugaucugcuuugucauucaaugcaguggggauucaggcccaaucaucugcgcaggacccauccacucaaacaagagugcugacauaccucaccugcuggguuauucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucugagccccugugaugcugauuggcuugggaugcuugucgugaagaaggccaaggggucugauaugauagucccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucggauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucauguaggggagacaugcaguucugcaagguggcagguugugaacauggggaagaggcaucugaagccaagugcagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguggauggaacugaauucacauuugaggguaguugcauguucccagaugguugugaugcgguggacugcacuuucugucgugaguuucuaaaaaauccccagugcuacccugcuaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggaucgagauggcaagacccagaaggguaaggcauuggauguacucaccugucauccugacuauuuuagcaauagggcuugcugagagcugugaugagaugguccaugcugauucuaagcuuguuucaugcaggcaagggagcggaaaugugaaggaaugugucacaacugggagggcgcuucuuccugcggugaacccaggucaagaggcgugucugcacuucacggcaccugggaguccggacucaaaaugucucaaaauuaggguuaagaggaucaaccuaaaauguaagaagucaucaucauauuuuguuccugaugcccgguccagauguacaucagugaggagaugucguugggcuggagacugccagucugggugccccccucauuucacauccaauuccuuuucugaugauugggcagguaagauggacagggcuggucuaggauucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugagaacauuccaccccaugaguggcauccccacacaagucuucaagggugugaguguaacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccucgugggcauagagcuacgaguggaugacgcugugugcuacucuaagaucacuaguguggaagcaguuguaaacuacucugccauacccaccacuauuggggggcugagguuugagagaagccaugacagccaggguaaaauaucugguagcccccuggacaucacagccauaagaggaucuuuuucuguuaauuauagaggccuucgacugagucucucagaaauuacugcaaccugcacaggggaggugacaaaugugaguggguguuauucuugcaugacaggcgccaaagucucuaucaaacugcauagcaacaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucacagcacugugcccacaggggcaaauaucccaagcccuacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacaaagcuggcuuag

SEQ ID NO: 4765 - RNA, 3222 nt, Artificial Sequence
  derived and/or modified CDS sequence (wt) from SFTSV(LN2012-58)__KF887440.1__GP
augaugaaagucaucugguucuccucucugaucugcuuugucauucaaugcaguggggacucgggcccaaucaucugcgcaggacccauccauucaaauaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagauucagggacuagcucuggucuucugcccucugauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaagugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguucacaagcccggagaaguuguugugucauauggagggaugcgugucaggccaaagugcuaugguuucuccagaaugauggcaacacuggaggugaaccaaccagugcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauacaauuccacucaggaucauugguugggaaaacagcaauacacgucaaaggggcauugguagauggaacugaauucacauuugaggguagcugcauguucccggaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauuggaauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuaguaauggggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccagacucaaaaugucucaaaauuaagguuaagaggaucaaccuaaaaugcaagaagucaucaucauauuuuguuccugaugcccgguccagauguacaucagugaggagaugucguugggcuggagacugccagucagggugccccccucauuucacauccaacuccuuuucugaugauugggcaggcaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcaucccuacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugaugcugugugcuacucuaagaucacuaguguggaagcaguugcaaacuacucugccauacccaccacuauuggggggcugagguuugagagaagccaugacagccaggguaaaauaucugguagcccucuggacaucacagcuauaagaggaucuuuuucaguuaauuauagaggccuucgacugagccucucagaaauuacugcuaccugcacaggggaggugacaaaugugagcggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacgaagcuggcuuag

SEQ ID NO: 4766 - RNA, 3222 nt, Artificial Sequence
  derived and/or modified CDS sequence (wt) from SFTSV(NB24/CHN/2013)__KR698337.1__GP
augaugaaagucaucugguucuccucucugaucugcuuagucauucaaugcaguggggacacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcagcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuccuggagcugaagaguuuuagccagagugaauucccagacauauguaaaauugauggcauuguguuuaaccagugugagagugagagucuaccucaacccuuugauguugcauggauggauguaggccacucucauaaaaucaucaugagggagcacaagaccaaaugggugcaagagagcucuucuaaggauuuugugugcuacaaggaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagccaggggaaguuguugugucauauggagggaugcgugucaggccaaaguguuaugguuucuccagaaugauggcaacacuagaggugaacccaccagagcaaaggauuggccaaugcacuggcugccaucuagaguguguaaaugggggugugaggcuaaucacucuaacuagugagcucaagucagcuacugucugugcuucccacuuuuguaguucugccacaaguggcaagaaaagcacagagauucaauuccacucagggucauuaguugggaaaacagcaauacacgucaaaggggcuuugguggauggaacugaauucacauuugagggcaguugcauguucccagaugguugugacgcaguggacugcacguucugucgugaguuucuaaaaaauccucaguguuacccugcaaagaaaugguuguucaucaauauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauuaauggauaggggaaggcaagugauccaugaggaaauaggggagaauagagagggcaaccaagaugauguuaggaucgagauggcaagacccagaaggguaaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcggugaacccagggcaagaggcaugucugcacuucacggcaccugggaguccggacucaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacauccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcauggguuccaucagcagucauagagcuaacaaugcccucaggggaagugaggacauuccacccuaugagcggcauccccacacagguuuucaagggugugagugugacuuacuuaggcucagauauggaggugucuggcuugacugaccugugugagauagaagagcucaagucuaagaagcuggcauuagcccccugcaaucaggcuggcauggggguuguaggcaagguuggagagauacagugcaguagcgaggaaagugcccgcaccauaaaaaaagauggguguauauggaaugcugaccuugugggcauagaacuacgaguggaugacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugagugguuguuacucuugcaugacaggcgccaaagucuccaucaaacugcauagcaacaaaaauagcacugcccauguaagaugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaauuuguggauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggucgaagcuggcuuag

SEQ ID NO: 4767 - RNA, 3222 nt, Artificial Sequence
  derived and/or modified CDS sequence (wt) from SFTSV(NB31/CHN/2013)__KR698338.1__GP
augaugaaagucaucugguucuccucucugaucugcuuugucauccaaugcaguggggauacgggcccaaucauaugcgcaggacccauccacucaaacaagagugccaacauaccccacuugcuugguuacucugagaagauuugucagauagaucgacugauacauguuucgucauggcugagaaaccauucacaauuucagggcuacguagggcagcgagguggacgcucccagguaaguuacuacccaucugaaaacucuaacucuagguggaguggacuucuaagccccugugaugcugauuggcuugggaugcuuguugugaagaaggccaaagggucugauaugauaguucccgggccuucauacaaggggaaagucuuuuuugaacggccaacuuuugauggauacguaggcuggggcuguggcagugggaagucacggacugagucaggagagcucugcaguucagacucagggaccaguucaggucuucugcccucagauagaguucucuggauaggugauguugcuugccagccuaugacacccaucccugaggagacauuucuggagcugaagaguuuuagccagagugaauucccagacauaugcaaaauugauggcauuguguucaaccagugugagagugagagucuaccucaacccuuugauguugcauggauggauguaggccacucucauaaaaucaucaugagggagcacaagaccaaauggguacaagagagcucuuccaaggauuuugugugcuacaaggaagggacugggccguguucugaaucagaagaaaagacuugcaagaccaguggaucaugcaggggggacaugcaguuuugcaagguggcagguugugagcauggggaagaggcaucugaggccaaguguagaugcucacuagugcacaagcccggggaaguuguugugucauauggagggaugcgugucagaccaaaguguuaugguuucuccagaaugauggcuacacuggaggugaacccaccagagcaaaggauuggccaaugcacuggcugccaucuagaauguauaaaugggggugugaggcuaaucacucuaacuagugagcucaagucagcuacugucugugcuucccacuuuuguaguucugccacaaguggcaagaaaaauacggagauucaauuccacucagggucauuaguugggaaaacaguaauacacgucaaaggggcuuugguggauggaacugaauucacauuugagggcaguugcauguucccagaugguugugaagcaguggacuguacauucugucgugaguuucuaaaaaauccacagugcuacccugcaaagaaaugguuguucaucauuauugucauccuccuuggauaugcaggccucaugcuacucaccaauguccuuaaggcaaucggaguuuggggaucaugggucauagcuccagugaagcuaauguuugccaucauaaagaaacugaugagaucugugagcugcuugauggggaaauuaauggauaggggaaggcaagugauccaugaagaaauaggggagaauagagagggcaaccgagaugauguuaggaucgagauggcaagaccuagaaggguaaggcauuggauguacucaccugucauccugacuauucuagcaauugggcuugcugagggcugcgaugagaugguccaugcagauucuaaacuuguuucgugcaagcaagggagcggaaauaugaaggaaugugucacaacugggagggugcuccuuccugcggugaacccaggacaagaggcaugccugcacuucacggcaccugggaguccggacucaaaaugucucaaaauuaagguuaagaggauuaaccuaaaauguaagaagucaucaucauauuuugucccugaugcucgguccagguguacaucugugaggagaugucgcugggcaggagacugccagucuggcugccccucucauuucacguccaacuccuuuucugaugauugggcagguaaaauggacagggcuggucuaggauucagugggugcucugauggauguggaggagcagccugcggcugcuuuaaugcggccccuucaugcaucuuuuggaggaaauggguagagaacccacaugggaucaucuggaaaguaucuccaugugcugcaugggucccaucagcagucauagaacuaacaaugcccucaggggaagugaggacauuccaccccaugagcggcaucccuacacaagucuuuaagggugugagugugacuuacuuaggcucagauauggaggugucuggcuugacugaccugugugagauagaagagcucaaguccaagaagcuggcauuagcccccugcaaucaggcuggcauggggguuguaggcaagguuggagagauacagugcaguagcgaggaaagugcccgcaccauaaaaaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccagggcaagauaucugguagcccccuagacaucacagccauaagagggucuuuuucaguuaauuauagaggccuucgacugagccuuucugaaauuacugcuacuugcacaggagaggugacgaaugugaguggguguuacucuugcaugacuggcgccaaagucuccauuaaacugcauagcagcaaaaauagcacugcccauguaagaugcaaaggggaugagacugcguucaguguccuggagggaguucauagcuauacugucagucucagcuuugaucaugcaguggucgaugagcagugccagcugaacuguggggggcaugagagucaagugacucuaaaaggcaaccucaucuuccuggaugucccaaaauuuguggauggcagcuauaugcagacauaucacaguucuguacccacaggggcuaauaucccaagcccuacagacuggcugaaugccuuguuuggcaaugggcugaguagguggauucugggggugguagggguucuacuggggggauugguucucuuuuucuuaaucaugucuuuguucaaauugggaacaaaacagguauuucgaucaaggacgaagcuggcuuag

SEQ ID NO: 4768 - RNA, 3222 nt, Artificial Sequence
  derived and/or modified CDS sequence (wt) from SFTSV(NB38/CHN/2013)__KR698341.1__GP
augaugaaagucaucugguucuccucucugaucugcuuagucauucaaugcgguggggauacgagcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuuguugugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucagcccuuugauguugcguggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacaugaggaagaggcaucugaagccaaguguagaugcucacuugugcacaagcccggagaagucguugugucauauggagggaugcguguaagaccaaagugcuaugguuucuccagaaugauggcaacacuggaggugaaccaaccagagcaaaggauuggucaaugcacuggcugccaucuagaaugcauaagugggggugugaggcugaucacucuaaccagugagcucaagucagcuacugucugcgcuucucacuuuuguaguucugccacaagugguaagaaaagcacggagauucaauuccacucaggaucauugguugggaaaacagcaauccacgucaaaggggcacugguagauggaacugaauucacauuugaggguaguugcauguuuccagaugguugugaugcaguggacugcacauucugucgugaguuucuaaaaaauccucagugcuacccugcaaagaaguggcuguucaucauuauugucauccuccuuggauaugcaggccucaugcuacucaccaauguucuuaaggcaauagggguuugggggucaugggucauagcuccagugaagcuaguguuugccaucauaaagaagcuaaugagagcugugagcugccugauggggaaauugauggauaggggaaggcaagugauccaugaggaaauaggggagaauagagagggcaaccaagaugauguuaggaucgagauggccagacccaggaggguaaggcauuggauguacucgccugucauccugacuauucuagcaauagggcuugcugagggcugugaugaaaugguccaugcugauucaaaacuuguuucgugcaggcaagggagcggaaauaugaaggaaugugucacaacugggagggcgcuucuuccugcggugaacccagggcaagaggcgugucugcacuuuacggcaccuggaaguccagacucaaaaugucucaaaauuaagguuaagaggaucaaccuaaaauguaagaagucaucaucauauuuuguuccugaugcccgguccagguguacaucagugaggagaugucguugggcaggagacugccagucugggugccccccucauuucacaucuaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccccaugggaucaucuggaaaguaucuccaugugccgcaugggucccaucagcagucauagagcuaacaaugcccucaggggaggugaggacauuccaccccaugagcggaauccccacacaagucuuuaagggugugaguguaacuuacuugggcucugauauggaggugucaggcuugacugaccugugugagauggaagagcucaagucaaaaaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacgaguggaugacgcugugugcuacucuaagaucacuaguguggaggcaguugcaaaccacuccgccauacccaccacuauuggggggcugagguuugagagaagccaugacagccaggguaaaauaucugguagcccccuggacaucacagcuauaagaggaucuuuuucugucaauuacagaggccuucgacugagucucucagaaauuacugcuacuuguacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagaguaaagugacucuaagaggcaaccucaucuuccuggaugucccgaaauuuguggauggcagcuacaugcagacauaucauaguacagugcccacaggggcaaauaucccaagcccuacagauuggcuaaaugccuuguuuggcaaugggcugaguaggugguuucugggaguaauagggguccuacuggggggauuggcucucuuuuucuugaucaugucuuuguucaagcugggaacaaaacaaguauuucgaucgaggucgaagcuggcuuag

SEQ ID NO: 4769 - RNA, 3222 nt, Artificial Sequence
  derived and/or modified CDS sequence (wt) from SFTSV(NB39/CHN/2014)__KR698342.1__GP
augaugaaaguuaucugguucuccucucugaucugcuuagucauucaaugcaguggggacacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcggcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuccuggagcugaagaguuuuagccagagugaauucccagacauauguaaaauugauggcauuguguuuaaccagugugagagugagagucuaccucaacccuuugauguugcauggauggauguaggccacucucauaaaaucaucaugagggagcacaagaccaaaugggugcaagagagcucuucuaaggauuuugugugcuacaaggaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagccaggggaaguuguugugucauauggagggaugcgugucaggccaaaguguuaugguuucuccagaaugauggcaacacuagaggugaacccaccagagcaaaggauuggccaaugcacuggcugccaucuagaguguguaaaugggggugugaggcuaaucacucuaacuagugagcucaagucagcuacugucugugcuucccacuuuuguaguucugccacaaguggcaagaaaagcacagagauucaauuccacucagggucauuaguugggaaaacagcaauacacgucaaaggggcuuugguggauggaacugaauucacauuugagggcaguugcauguucccagaugguugugacgcaguggacugcacguucugucgugaguuucuaaaaaauccucaguguuacccugcaaagaaaugguuguucaucauuauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauuaauggauaggggaaggcaagugauccaugaggaaauaggggagaauagagagggcaaccaagaugauguuaggaucgagauggcaagacccagaaggguaaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcggugaacccagggcaagaggcaugucugcacuucacggcaccugggaguccggacuuaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacauccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcauggguuccaucagcagucauagagcuaacaaugcccucaggggaagugaggacauuccacccuaugagcggcauccccacacagguuuucaagggugugagugugacuuacuuaggcucagauauggaggugucuggcuugacugaccugugugagauagaagagcucaagucuaagaagcuggcauuagcccccugcaaucaggcuggcauggggguuguaggcaagguuggagagauacagugcaguagcgaggaaagugcccgcaccauaaaaaaagauggguguauauggaaugcugaccuugugggcauagaacuacgaguggacgacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugagugguuguuacucuugcaugacaggcgccaaagucuccaucaaacugcauagcaacaaaaauagcacugcccauguaagaugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaauuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggacgaagcuggcuuag

SEQ ID NO: 4770 - RNA, 3222 nt, Artificial Sequence
  derived and/or modified CDS sequence (wt) from SFTSV(QD7)__KR706566.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugaugucgcuugucagccuaugacacccaucccugaagagacauuucuggagcugaagaguuuuagccaaagugaauucccagacauaugcaaaauugauggcauuguguucaaccagugugaaggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcgacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcaguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacuaugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuugcuucaugcaggcaagguagcggaaauaugaaggaaugugucacaacugggagggcgcuucauccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagauguacaucagugaggagaugucgcugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagcuccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggagguaucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuacagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacagcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4771 - RNA, 3222 nt, Artificial Sequence
  derived and/or modified CDS sequence (wt) from SFTSV(Rodent01/NB/CHN/2014)__KR698343.1__GP
augaugaaaguuaucugguucuccucucugaucugcuuagucauucaaugcaguggggacacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcggcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuccuggagcugaagaguuuuagccagagugaauucccagacauauguaaaauugauggcauuguguuuaaccagugugagagugagagucuaccucaacccuuugauguugcauggauggauguaggccacucucauaaaaucaucaugagggagcacaagaccaaaugggugcaagagagcucuucuaaggauuuugugugcuacaaggaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagccaggggaaguuguugugucauauggagggaugcgugucaggccaaaguguuaugguuucuccagaaugauggcaacacuagaggugaacccaccagagcaaaggauuggccaaugcacuggcugccaucuagaguguguaaaugggggugugaggcuaaucacucuaacuagugagcucaagucagcuacugucugugcuucccacuuuuguaguucugccacaaguggcaagaaaagcacagagauucaauuccacucagggucauuaguugggaaaacagcaauacacgucaaaggggcuuugguggauggaacugaauucacauuugagggcaguugcauguucccagaugguugugacgcaguggacugcacguucugucgugaguuucuaaaaaauccucaguguuacccugcaaagaaaugguuguucaucauuauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauuaauggauaggggaaggcaagugauccaugaggaaauaggggagaauagagagggcaaccaagaugauguuaggaucgagauggcaagacccagaaggguaaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcggugaacccagggcaagaggcaugucugcacuucacggcaccugggaguccggacuuaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacauccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcauggguuccaucagcagucauagagcuaacaaugcccucaggggaagugaggacauuccacccuaugagcggcauccccacacagguuuucaagggugugagugugacuuacuuaggcucagauauggaggugucuggcuugacugaccugugugagauagaagagcucaagucuaagaagcuggcauuagcccccugcaaucaggcuggcauggggguuguaggcaagguuggagagauacagugcaguagcgaggaaagugcccgcaccauaaaaaaagauggguguauauggaaugcugaccuugugggcauagaacuacgaguggacgacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugagugguuguuacucuugcaugauaggcgccaaagucuccaucaaacugcauagcaacaaaaauagcacugcccauguaagaugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaauuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggacgaagcuggcuuag

SEQ ID NO: 4772 - RNA, 3222 nt, Artificial Sequence
  derived and/or modified CDS sequence (wt) from SFTSV(SDLZtick12/2010)__JQ684872.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugaaggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugaaccaaccagagcaaaggauuggccaaugcacuggcugccaucuggaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcaguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagaggguaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcuuuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacagcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggagcaaauaucccaagcccaacagacuggcugaaugccuuguuuggcaaugggcugagcagguggauccugggggugauagggguucugcuugggggguuggcucucuuuuuuaugauuaugucuuuguucaagcugggaacaaaacagguauuucgaucaaggacaaagcuggcuuag

SEQ ID NO: 4773 - RNA, 3222 nt, Artificial Sequence
  derived and/or modified CDS sequence (wt) from SFTSV(Zhao)__KF374684.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaguaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4774 - RNA, 3222 nt, Artificial Sequence
  derived and/or modified CDS sequence (wt) from SFTSV(Zhejiang/01/2011)__KJ597824.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugaugcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcacgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4775 - RNA, 3222 nt, Artificial Sequence
  derived and/or modified CDS sequence (wt) from SFTSV(ZJ2013-06)__KP280204.1__GP
augaugaaagucaucugguucuccucucugaucugcuuagucauucaaugcaguggggacacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcagcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuccuggagcugaagaguuuuagccagagugaauucccagacauauguaaaauugauggcauuguguuuaaccagugugagagugagagucuaccucaacccuuugauguugcauggauggauguaggccacucucauaaaaucaucaugagggagcacaagaccaaaugggugcaagagagcucuucuaaggauuuugugugcuacaaggaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagccaggggaaguuguugugucauauggagggaugcgugucagaccaaaguguuaugguuucuccagaaugauggcaacacuagaggugaacccaccagagcaaaggauuggccaaugcacuggcugccaucuagaguguguaaaugggggugugaggcuaaucacucuaacuagugagcucaagucagcuacugucugugcuucccacuuuuguaguucugccacaaguggcaagaaaagcacagagauucaauuccacucagggucauuaguugggaaaacagcaauacacgucaaaggggcuuugguggauggaacugaauucacauuugagggcaguugcauguucccagaugguugugacgcaguggacugcacguucugucgugaguuucuaaaaaauccucaguguuacccugcaaagaaauggcuguucaucaauauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauuaauggauaggggaaggcaagugauccaugaggaaauaggggagaauagagagggcaaccaagaugauguuaggaucgagauggcaagacccagaaggguaaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcggugaacccagggcaagaggcaugucugcacuucacggcaccugggaguccggacucaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacauccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcauggguuccaucagcagucauagagcuaacaaugcccucaggggaagugaggacauuccacccuaugagcggcauccccacacagguuuucaagggugugagugugacuuacuuaggcucagauauggaggugucuggcuugacugaccugugugagauagaagagcucaagucuaagaagcuggcauuagcccccugcaaucaggcuggcauggggguuguaggcaagguuggagagauacagugcaguagcgaggaaagugcccgcaccauaaaaaaagauggguguauauggaaugcugaccuugugggcauagaacuacgaguggaugacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugagugguuguuacucuugcaugacaggcgccaaagucuccaucaaacugcauagcaacaaaaauagcacugcccauguaagaugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaauuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggacgaagcuggcuuag

SEQ ID NO: 4776 - RNA, 3222 nt, Artificial Sequence
  derived and/or modified CDS sequence (wt) from SFTSV(ZJZHSH-AM/China/05/2012)__KR017846.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacauacaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcuaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaaugcaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggaaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4777 - RNA, 3222 nt, Artificial Sequence
  derived and/or modified CDS sequence (wt) from SFTSV(ZJZHSH-CXD/China/05/2012)__KR017858.1__GP
augaugaaagucaucugguucuccucucugaucugcuuagucauucaaugcgguggggauacgggcccaaucaucugcgcaggacccauccacucaaacaagagugcuggcauaccccaccugcuuggcuacucugagaagauuugucagauagaucggcugauacauguuucgucauggcucagaaaccacucacaauuucagggcuacguagggcagcgagguggacgcucucaggugagcuacuacccggcugaaaauucuuacucaagguggaguggacuucuaagccccugugaugcugauuggcuagggaugcuugucgugaagaaggccaaggggucugauaugauaguuccugggcccucauacaagggaaaagucuuuuuugaacggccaacuuuugauggauacguaggcuggggcugugguagugggaagucuaggacugagucaggugagcucugcaguucagacucugggacuagcucuggucuucugcccucagauaggguucucuggauaggugauguugcuugucagccuaugacacccaucccugaggagacauuucuggagcugaagagcuuuagccaaagugaauucccagacguaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuuguacacaagcccggggaagucguugugucauauggagggaugcgugucagaccaaagugcuauggauucuccagaaugauggcaacacuggaggugaacccaccagagcaaaggauuggucaaugcacuggcugccaucuagaaugcauaaauggaggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguagcugcauguucccagaugguugugaugcaguggacugcacauucugucgugaguuucuaaaaaauccucagugcuacccugcaaagaaguggcuguucaucauuauugucauccuccuaggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaaaaugauguuaggaucgagauggccagacccaggaggguaaggcauuggauguacucgccugucauccugacuauucuagcaauaggguuugcugagggcugugaugagaugguccaugcugauucuaaacuuguuucgugcaggcaagggagcgaaaauaugaaggaauguguuacaacugggagggcgcuucuuccugcagugaacccugggcaagaggcgugucugcacuucacggcaccuggaaguccggacucaaaaugucucaaaauuaagguuaagaggaucaaccuaaaauguaagaagucaucaucauauuuuguuccugaugcccgguccaggugcacaucagugaggagaugucguugggcaggggacugccagucugggugccccccucauuucacauccaacuccuuuucugaugauugggcagguaagauggacagggcuggucuaggauucaguggcugcucugauggguguggaggagcagccugcgguugcuuuaaugcggccccuucaugcauuuucuggaggaaauggguagagaauccacaugggaucaucuggaaaguaucuccaugugccgcaugggucccaucagcaguuauagagcuaacaaugcccucaggggaggugaggacauuccaccccaugagcggaauccccacacaagucuucaagggugugaguguaacuuaccugggcucagacauggaggugucaggccugacugaccugugugagauagaagagcucaagucaaagaagcuugcauuagcucccugcaaccaggcugguauggggguuguaggcaagguuggagagauacagugcaguagcgaggaaagugcccguaccauaaagaaagaugggugcauauggaaugcugaccucguggguauagagcuacgaguggaugacgcugugugcuacucuaagaucacuaguguggaggcaguugcaaacuacuccgccauacccaccacuauuggggggcugagguuugagagaagccaugacagccaggguaaaauaucuggaagcccccuggacaucacagcuauaagaggauccuuuucuguuaauuauagaggccuucgacugagucucucagaaauuacugcuacuugcacaggggaagugacaaaugugaguggguguuauucuugcaugacaggcgccaaagucuccaucaaauugcauagcagcaaaaauagcacugcccauguaagaugcaaaggggaugagacugcauucagugucuuggagggaguccauagcuacucugucagucuaaguuuugaucaugcaguagucgaugagcagugccaacugaacugugggggacaugagagucaagugacucuaagaggcaaccucaucuuccuggaugucccgaaauuuguggauggcagcuacaugcagacauaucauaguacugugcccacaggggcaaacaucccaagcccuacagauuggcugaaugccuuguuuggcaaugggcugaguagguggauucuuggggugauagggguccuacuggggggauuggcucucuuuuucuugaucaugucuuuguucaagcugggaacaaaacagguauuucgaucgaggacgaagcuggcuuag

SEQ ID NO: 4778 - RNA, 3222 nt, Artificial Sequence
  derived and/or modified CDS sequence (wt) from SFTSV(ZJZHSH-FDE/China/06/2012)__KR017859.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacugugggggacaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4779 - RNA, 3222 nt, Artificial Sequence
  derived and/or modified CDS sequence (wt) from SFTSV(ZJZHSH-FZHR/China/07/2013)__KR017862.1__GP
augaugaaagucaucugguucuccucucugaucugcuuagucauucaaugcgguggggauacgggcccaaucaucugcgcaggacccauccacucaaacaagcgugcuggcauaccccaccugcuuggcuacucugagaagauuugucagauagaucggcugauacauguuucgucauggcucagaaaccacucacaauuucagggcuacguagggcagcgagguggacgcucucaggugagcuacuacccggcugaaaauucuuacucaagguggaguggacuucuaagccccugugaugcugauuggcuagggaugcuugucgugaagaaggccaaggggucugauaugauaguuccugggccuucauacaagggaaaagucuuuuuugaacggccaacuuuugauggauacguaggcuggggcugugguagugggaagucuagaacugagucaggugagcucugcaguucagacuccgggacuagcucuggucuucugcccucugauaggguucucuggauaggugauguugcuugucagccuaugacacccaucccugaggagacauuucuggagcugaagagcuuuagccaaagugaauucccagacguaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuauggauucuccagaaugauggcaacacuggaggugaacccaccagagcaaaggauuggucaaugcacuggcugccaucuagaaugcauaaauggaggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguagcugcauguucccagaugguugugaugcaguggacugcacauucugucgugaguuucuaaaaaauccucagugcuacccugcaaagaaguggcuguucaucauuauugucauccuccuaggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggaucgagauggccagacccaggagggugaggcauuggauguacucgccugucauccugacuauucuagcaauagggcuugcugagggcugugaugagaugguccaugcugauucuaaacuuguuucgugcaggcaagggagcggaaauaugaaggaauguguuacaacugggagggcgcuucuuccugcggugaacccugggcaagaggcgugucugcacuucacggcaccuggaaguccggacucaaaaugucucaaaauuaagguuaagaggaucaaccuaaaauguaagaagucaucaucauauuuuguuccugaugcccgguccaggugcacaucagugaggagaugucguugggcaggggacugccagucugggugccccccucauuucacauccaacuccuuuucugaugauugggcagguaagauggacagggcuggucuaggauucaguggcugcucugauggguguggaggagcagccugcgguugcuuuaaugcggccccuucaugcauuuucuggaggaaauggguagagaauccacaugggaucaucuggaaaguaucuccaugugccgcaugggucccaucagcaguuauagagcuaacaaugcccucaggggaggugaggacauuccaccccaugagcggaauccccacacaagucuucaagggugugaguguaacuuaccugggcucagacauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaagaaagaugggugcauauggaaugcugaccucguggguauagagcuacgaguggaugacgcugugugcuacucuaagaucacuaguguggaggcaguugcaaacuacuccgccauacccaccacuauuggggggcugagguuugagagaagccaugacagccaggguaaaauaucuggaagcccccuggacaucacagcuauaagaggauccuuuucuguuaauuauagaggccuucgacugagucucucagaaauuacugcuacuugcacaggggaagugacaaaugugaguggguguuauucuugcaugacaggcgccaaagucuccaucaaauugcauagcagcaaaaauagcacugcccauguaagaugcaaaggggaugagacugcauucagugucuuggagggaguccauagcuacucugucagucuaaguuuugaucaugcaguagucgaugagcagugccaacugaacugugggggacaugagagucaagugacucuaagaggcaaccucaucuuccuggaugucccgaaauuuguggauggcagcuacaugcagacauaucauaguacugugcccacaggggcaaauaucccaagcccuacagauuggcugaaugccuuguuuggcaaugggcugaguagguggauucuuggggugauagggguccuacuggggggauuggcucucuuuuucuugauuaugucuuuguucaagcugggaacaaaacagguauuucgaucgaggacgaagcuggcuuag

SEQ ID NO: 4780 - RNA, 3222 nt, Artificial Sequence
  derived and/or modified CDS sequence (wt) from SFTSV(ZJZHSH-HCY/China/06/2012)__KR017855.1__GP
augaugaaagucaucugguuccccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggauugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauaccaaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuauucaugucuuuguucaaacugggaacaaaacagguauuucgaucaaggacgaagcuggcuuag

SEQ ID NO: 4781 - RNA, 3222 nt, Artificial Sequence
  derived and/or modified CDS sequence (wt) from SFTSV(ZJZHSH-HYC/China/05/2012)__KR017847.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuagucgggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagaaagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaaugcaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuacacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguuuuucgaucaaggacgaagcuggcuuag

SEQ ID NO: 4782 - RNA, 3222 nt, Artificial Sequence
  derived and/or modified CDS sequence (wt) from SFTSV(ZJZHSH-HYJ/China/07/2012)__KR017852.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaagucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaagggggaugagaccgcguucaguguacuggaggggguucauagcuacacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4783 - RNA, 3222 nt, Artificial Sequence
  derived and/or modified CDS sequence (wt) from SFTSV(ZJZHSH-LU/China/10/2011)__KR017850.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacaugugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauaccaaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcuguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucugcuggggggauuagcccucuucuucuuaaucaugucuuuguucaaacugggaacaaaacagguauuucgaucaaggacgaagcuggcuuag

SEQ ID NO: 4784 - RNA, 3222 nt, Artificial Sequence
  derived and/or modified CDS sequence (wt) from SFTSV(ZJZHSH-SHZ/China/05/2012)__KR017848.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugaacggccaacuuuugauggauacgugggcuggggcuguggcagugggaagucaaggacagagucaggugagcucugcaguucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacucuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugacgcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauaccaaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauggcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4785 - RNA, 3222 nt, Artificial Sequence
  derived and/or modified CDS sequence (wt) from SFTSV(ZJZHSH-WSH/China/08/2012)__KR017854.1__GP
augaugaaagucaucugguucuccucucugaucugcuuagucauucaaugcgguggggauacgggcccaaucaucugcgcaggacccauccacucaaacaagagugcuggcauaccccaccugcuuggcuacucugagaagauuugucagauagaucggcugauacauguuucgucauggcucagaaaccacucacaauuucagggcuacguagggcagcgagguggacgcucucaggugagcuacuacccggcugaaaauucuuacucaagguggaguggacuucuaagccccugugaugcugauuggcuagggaugcuugucgugaagaaggccaaggggucugauaugauaguuccugggcccucauacaagggaaaagucuuuuuugaacggccaacuuuugauggauacguaggcuggggcugugguagugggaagucuaggacugagucaggugagcucugcaguucagacuccgggacuagcucuggucuucugcccucagauaggguucucuggauaggugauguugcuugucagccuaugacacccaucccugaggagacauuucuggagcugaagagcuuuagccaaagugaauucccagacguaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcaaaagcccggggaagucguugugucauauggagggaugcgugucagaccaaagugcuauggauucuccagaaugauggcaacacuggaggugaacccaccagagcaaaggauuggucaaugcacuggcugccaucuagaaugcauaaauggaggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguagcugcauguucccagaugguugugaugcaguggacugcacauucugucgugaguuucuaaaaaauccucagugcuacccugcaaagaaaugguuguucauuauuauugucauccuccuuggauaugcaggccucaugcuacucaccaauguccuuaaagcaaucgggguuuggggaucaugggucauagcuccagugaagcuaauguuugccaucaugaagaaacugaugagaucugugagcugcuugauggggaaauugauggauaggggaaggcaagugauccaugaagaaauaggggagaauagagagggcaaccaagaugauguuaggaucgagaugguaagacccagaagggugaggcauuggauguacucuccugucauccugacuauucuagcaauugggcuuacugagggcugcgaugagaugguccaugcagauucuaaacuuguuucgugcaggcaagggagcggaaauaugaaggaaugugucacaacugggagggcgcuccuuccugcggugaacccugggcaagaggcgugucugcacuucacggcaccuggaaguccggacucaaaaugucucaaaauuaagguuaagaggaucaaccuaaaauguaagaagucaucaucauauuuuguuccugaugcccgguccaggugcacaucagugaggagaugucguugggcaggggacugccagucugggugccccccucauuucacauccaacuccuuuucugaugauugggcagguaagauggacagggcuggucuaggauucaguggcugcucugauggguguggaggagcagccugcgguugcuuuaaugcggccccuucaugcauuuucuggaggaaauggguagagaauccacaugggaucaucuggaaaguaucuccaugugccgcaugggucccaucagcaguuauagagcuaacaaugcccucaggggaggugaggacauuccaccccaugagcggaauccccacacaagucuucaagggugugaguguaacuuaccugggcucagacauggaggugucaggccugacugaccugugugagauagaagagcucaagucaaagaagcuugcauuagcucccugcaaccaggcugguauggggguuguaggcaagguuggagagauacagugcaguagcgaggaaagugcccguaccauaaagaaagaugggugcauauggaaugcugaccucguggguauagagcuacgaguggaugacgcugugugcuacucuaagaucacuaguguggaggcaguugcaaacuacuccgccauacccaccacuauuggggggcugagguuugagagaagccaugacagccaggguaaaauaucuggaagcccccuggacaucacagcuauaagaggauccuuuucuguuaauuauagaggccuucgacugagucucucagaaauuacugcuacuugcacaggggaagugacaaaugugaguggguguuauucuugcaugacaggcgccaaagucuccaucaaauugcauagcagcaaaaauagcacugcccauguaagaugcaaaggggaugagacugcauucagugucuuggagggaguccauagcuacucugucagucuaaguuuugaucaugcaguagucgaugagcagugccaacugaacugugggggacaugagagucaagugacucuaagaggcaaccucaucuuccuggaugucccgaaauuuguggauggcagcuacaugcagacauaucauaguacugugcccacaggggcaaauaucccaagcccuacagauuggcugaaugccuuguuuggcaaugggcugaguagguggauucuuggggugauagggguccuacuggggggauuggcucucuuuuucuugaucaugucuuuguucaagcugggaacaaaacagguauuucgaucgaggacgaagcuggcuuag

SEQ ID NO: 4786 - RNA, 3222 nt, Artificial Sequence
  derived and/or modified CDS sequence (wt) from SFTSV(ZJZHSH-XAM/China/06/2012)__KR017853.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugccagauagaucggcugauacauguuucgucauggcugagaaaccauucacaauuucagggcuacguggggcagcgagguggacgcucucaggugaguuacuacccagcugaaaacucuuacucaagguggaguggacuucuaagccccugugaugcugauuggcuuggaaugcuugucgugaagaaggccaaggggucugauaugauaguuccugggccuucauacaagggaaaagucuuuuuugagcggccaacuuuugauggauacgugggcuggggcuguggcagugggaagucaaggacagagucaggugagcucugcagcucagacucagggaccaguucuggucuucugcccucagauaggguucucuggauaggugauguugcuugccagccuaugacacccaucccugaggagacauuucuggagcugaagaguuuuagccagagugaauucccagacauaugcaagauugauggcauuguguucaaccagugugagagugagagucuaccucagcccuuugaugucgcauggauggauguaggucacucucauaaaaucaucaugagggagcacaagaccaaauggguacaggagagcucaucuaaggacuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuagugcacaagcccggggaaguuguugugucauauggagggaugcgugucaggccaaaguguuaugguuucuccagaaugauggcaacacuggaggugaacccaccagagcaaagaauuggccaaugcacuggcugccaucuagaaugcauaaaugggggugugaggcuagucacccuaacuagugagcucaagucagcuacugucugugcuucccacuuuuguaguucugccacaaguggcaagaaaagcacggagauucaauuccauucugggucauuaguugggaaagcagcaauacacgucaaaggggcuuugguggaugguacagaauucacauuugagggcaguugcauguucccagaugguugugaugcaguggacugcacauucugucgugaguuucuaaaaaauccucagugcuacccugcaaagaaguggcuguucaucauuauugucauccuccuaggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggaucgagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuccuuccugcggugaacccaggacaagaggcaugucugcacuucacggcaccugggaguccggacucaaaaugucucaaaaucaagguuaagaggaucaaccuaaaauguaagaagucaucaucauauuuuguuccugaugcucgguccagguguacaucugugaggagaugucgcugggcaggagacugccagucugggugccccucucauuucacguccaacuccuucucugaugauugggcagguaaaauggauagggcuggucuaggauuuagugggugcucugauggguguggaggagcagccugcggcugcuuuaaugcggccccuucaugcaucuuuuggaggaaauggguagagaauccacaugggaucaucuggaaaguaucuccaugugcugcaugggucccuucagcagucauagagcuaacaaugcccucgggggaagugaggacauuccaccccaugagcggcaucccaacacaagucuucaagggugugagugugacuuacuuaggcucagauauggaggugucuggcuugacugaccugugugagauagaagagcucaaguccaagaagcuggcauuagcucccugcaaucaggcuggcauggggguuguaggcaagguuggagagauacagugcaguagcgaggaaagcgcucguaccauaaagaaagauggguguauauggaaugcugaccuugugggcauagagcuacgaguggaugacgcugugugcuacucuaagaucacuaguguggaggcaguugcaaacuacucugccauaccaaccacuauuggggggcugagguuugagagaagccaugacagccaggguaaaauaucugguagcccccuagacaucacagccauaagagggucuuuuucaguuaauuauagaggccuucgacugagccucucagaaaucacugcuacuugcacaggagaggugacgaaugugaguggauguuacucuugcaugacaggugccaaagucuccaucaaacugcauagcagcaaaaauagcacugcccaugugagaugcaaaggggaugagaccgcguucaguguacuggaggggguucauagcuauacugucagucucagcuuugaccaugcaguggucgacgagcagugccagcugaacuguggggggcaugagagucaagugacucuaaaaggcaaccucaucuuccuggaugucccaaaauuuguagauggcagcuauaugcagacauaucauaguucugugcccacaggagcuaauaucccaagcccaacagacuggcugaaugccuuguuuggcaaugggcugaguagguggauucugggggugauagggguucuacuggggggauuagcccucuucuucuuaaucaugucuuuguucaaacugggaacaaaacagguauuucgaucaaggacgaagcuggcuuag

SEQ ID NO: 4787 - RNA, 3222 nt, Artificial Sequence
  derived and/or modified CDS sequence (wt) from SFTSV(ZJZHSH-YJX/China/06/2012)__KR017860.1__GP
augaugaaagucaucugguucuccucucugaucugcuuagucauucaaugcaguggggauacgggcccaaucauaugcgcagggcccauccacucaaacaagagugccaacauaccccaccugcuuggcuacucugagaagauuugucagauagaucggcugauacauguuucgucauggcugagaaaccauucacaauuucagggcuauguggggcagcgagguggacgcucucagguaagcuauuacccagcugaaaacucuuacucaagguggaguggacuucuaagccccugugaugcugauuggcuugggaugcuuguugugaagaaggccaaagggucugauaugauaguuccugggccuucauacaagggaaaagucuuuuuugaacggccaacuuuugauggauacguaggcuggggcuguggcagugggaagucaaggacagagucaggggagcucugcagcucagacucagggaccaguuccggucuucugcccucagauaggguucucuggauaggugauguugcuugccagcccaugacacccaucccugaggagacauuucuggagcugaagaguuuuagccagagugaauucccagacauaugcaaaauugauggcauuguguucaaccagugugagagugagagucuaccucaacccuuugauguugcguggauggauguaggccacucucauaaaaucaucaugagggagcacaagacuaaauggguacaagagagcucaucuaaggauuuugugugcuacaaggaagggacugggccauguucugaaucagaagaaaagacuugcaagaccaguggaucaugcaggggggacaugcaguuuugcaagguggcagguugugaacauggggaagaagcaucugaugccaaguguagaugcucacuagugcacaagcccggggaaguuguugugucauauggagggaugcgugucagaccaaaguguuauggcuucuccagaaugauggcaacacuagaggugaacccaccagagcaaaggauuggccaaugcacuggcugccaucuugaaugcauaaaugggggugugaggcuaaucacucugacuagugagcucaggucagcuacugucugugcuucccacuuuuguaguucugccacaaguggcaagaaaagcacggaaauucaauuccacucagggucauuaguugggaaaacaacaauacacgucaaaggggcuuugguggauggaacugaauucacauuugagggcaguugcauguucccagaugguugugacgcaguggacugcacauucugucgugaguuucuaaaaaauccucagugcuacccugcaaagaaauggcuguucaucauuauugucauccuccuuggauaugcaggccucaugcuacuuaccaauguccuuaaggcaaucgggguuuggggaucaugggucauagcuccagugaagcuaauguuugccaucauaaagaaacugaugagaucugugagcugcuugauggggaaauuaauggauaggggaaggcaagugauccaugaagaaauaggggagaauagagagggcaaccaagaugauguuaggaucgagauggcaagacccagaaggguaaggcauuggauguacucaccugucauccugaccauucuagcaauugggcuugccgagggcugcgaugagaugguccaugcagacuccaaacuuguuucgugcaagcaagcgagcggaaacaugaaggaaugugucacaacugggagggcacuccuuccugcggugaacccaggacaagaggcaugucugcacuucacggcaccugggaguccggacucaaaaugucucaaaauuaaggucaagaggauuaaccuaaaauguaagaagucaucaucauauuuuguucuugaugcucggucuagguguacaucugugaggagaugucgcugggcaggagacugccagucugggugccccucucauuucacguccaacuccuuuucugaugauugggcagguaaaauggacagggcaggucuaggauucagugggugcucugauggauguggaggagcagccugcggcugcuuuaaugcagccccuucaugcaucuuuuggaggaaauggguagagaacccgcaugggaucaucuggaaaguaucuccaugugcugcaugggucccaucagcagucauagagcuaacaaugcccucaggggaagugaggacauuccaccccaugagcggcaucccuacacaagucuucaagggugugagugugacguacuuaggcucagauauggaggugucuggcuugacugaccugugugagauagaagaacucaaguccaagaagcuagcauuagcccccugcaaucaggcuggcauggggguuguaggcaagguuggagagauacagugcaguagcgaggaaagugcccguaccauaaaaaaagauggguguauauggaaugcugaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagccccuuagauauaacagccauaagagggucuuuuucaguuaauuauagaggccuucgacugagccucucagagguuacugcuacuugcacaggagaggugacgaaugugaguggguguuacucuugcaugacaggcgccaaagucuccaucaaacugcauagcagcaaaaauagcacugcccauguaagaugcaaaggggaugagacagcauucaguguccuagagggaguucauagcuauacugucagucucagcuuugaccaugcaguggucgaugagcagugccagcugaacuguggagggcaugagagucaagugacucuaaaaggaaaccucaucuuccuggaugucccaaaauuuguagauggcagcuauaugcagacauaucauaguucugugcucacaggggccaacaucccaagcccuacagacuggcugaaugccuuguucggcaaugggcugaguaaguggauucuggggguaauagggguucuacuggggggauuggcucucuuuuucuuaaucaugucucuguucaaauugggaacaaaacagauauuucgaucaaggacgaagcuggcuuaa

SEQ ID NO: 4788 - RNA, 3222 nt, Artificial Sequence
  derived and/or modified CDS sequence (wt) from SFTSV(SPL003A)__AB817988.1__GP
augaugaaagucaucugguucuccucucugaucugcuuagucauccaaugcaguggggauacgggcccaaucauaugcgcagggcccauccacucaaacaagagugccaacauaccccaccugcuugguuauucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagcccgugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaauccaggacaagaggcaugucugcacuucacagcaccagggagcccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4789 - RNA, 3222 nt, Artificial Sequence
  derived and/or modified CDS sequence (wt) from SFTSV(SPL004A)__AB817989.1__GP
augaugaaagucaucugguucuccucucugaucugcuuggucauucaaugcaguggggacacgggcccaaucauaugugcagggcccauccacucaaacaagagugccaacauaccccaccugcuugguuacucugagaagauuugucagauagaucgacugauacauguuucgucauggcugagaaaccauucacaguuucagggcuacguggggcagcgagguggacgcucucaggugagcuacuacccagcugaaaacucuuacucaagguggagcggacuucuaagccccugugaugcugauuggcuugggaugcuuguugugaagaaggccaaggggucugauaugauaguuccuggaccaucauacaaggggaaagucuuuuuugagcggccaacuuuugauggauacgugggcuggggcugugguagugggaagucaaggacagagucaggugaacucugcagcucagacucagggaccaguucuggucuucugcccucagauagaguucucuggauaggugauguugcuugccagccuaugacacccaucccugaggagacauuucuggagcugaagaguuuuagccagagugaauucccagacauaugcaagauugauggcauuguguucaaucagugugagagugagaguuuaccucagcccuuugaugucgcauggauggauguaggucacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaguguagauguucucuagugcacaagcccggggaaguuguugugucauauggagggaugcgugucagaccaaaguguuaugguuucuccagaaugauggcaacacuagaggugaacccaccagagcaaaggauuggccaaugcacuggcugccaucuagaaugcauaagugggggugugaggcuaaucacucuaacuagugagcucaagucagccacugucugugcuucccacuuuuguaguucugccacaaguggcaagaaaagcacggagauucaauuccacucagggucauuaguugggaaagcagcaauacacgucaaaggggcuuugguggauggaacugaauucacauuugaggguaguugcauguucccagaugguugugacgcaguggauugcacauucugucgugaguuucuaaagaauccucagugcuacccugcaaagaaaugguuguucauuauuauugucauccuccuuggauaugcaggccucaugcuacucaccaauguccuuaaggcaaucgggguuuggggaucaugggucauagcuccagugaagcuaauguuugccaucaugaagaaacugaugagaucugugagcugcuugauggggaaauugauggauaggggaaggcaagugauccaugaagaaauaggggagaauagagagggcaaccaagaugauguuaggaucgagauggcaagaccgagaagggugaggcauuggauguacucaccugucauccugacuauucuagcaauugggcuagcugagggcugcgaugagaugguccaugcugauucuaaacuuguuucgugcaggcaagggagugggaacaugaaagaaugugucacaacugggagggcgcuccuuccugcggugaacccuggacaagaggcaugucugcacuucacggcaccugggagcccggacucaaaaugucucaagaucaagguuaagaggaucaaccuaaaauguaagaagucaucaucauauuuuguuccugaugcuagauccagguguacaucugugaggagaugucgcugggcaggagacugucagucugggugccccucucauuucacguccaacuccuucucugaugauugggcagguaaaauggacagggcuggucuaggauucagugggugcucugauggauguggaggagcagccugcggcugcuuuaaugcggccccuucaugcaucuuuuggaggaaauggguagagaauccacaugggaucaucuggaaaguaucuccaugugcugcaugggucccaucagcagucauagagcuaacgaugcccucgggggaagugaggacauuccaccccaugaguggcauccccacacaagucuucaagggugugagugugacuuacuuaggcucagauauggaggugucuggcuugacugaccugugugagauagaagagcuaaaguccaagaagcuggcauuagcucccugcaaucaggcuggcauggggguaguaggcaagguuggagagauacagugcagcagcgaggaaagcgcccguacuauaaagaaagaugggugcauauggaaugcugaccuuguaggcauagagcuacggguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaauuacugccacuugcacuggggaggugacgaaugugaguggguguuacucuugcaugacaggcgccaaagucuccaucaaacugcauagcagcaaaaauagcacugcccauguaagaugcaaagaggaugagaccgcguuuaguguccuggagggaguucauagcuauacugucagucucagcuuugaccaugcaguggucgaugagcagugccagcugaacuguggggggcaugagagucaugugacucuaaaaggcaaccuuaucuuccuggaugucccaaaauuuguagauggcagcuauaugcagacauaucauaguucugugcccacaggggcuaauaucccaagcccgacagacuggcugaaugccuuguuuggcaaugggcugaguagauggauucugggggugauggggguucugcuggggggguuggcucucuucuucuuaaucaugucuuuguucaaacugggaacaaaacagguauuucgaucaaggacgaagcuggcuuag

SEQ ID NO: 4790 - RNA, 3222 nt, Artificial Sequence
  derived and/or modified CDS sequence (wt) from SFTSV(SPL005A)__AB817990.1__GP
augaugaaagucaucugguucuccucucugaucugcuuagucauucaaugcaguggggaugcgagcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacuuuugauggauacguuggcuggggcuguggcagugggaagucaaggacugagucaggggagcucugcagcucagacucagggaccaguuccggucuucugcccucagauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagccccuugauguugcuuggauggauguuggccacucucauaaaaucaucaugagggagcacaagaccaaaugggugcaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaagugcagaugcucacuagugcacaagcccggggaaguuguugugucauauggagggaugcgugucagaccaaagugcuaugguuucuccagaaugauggcaacacuagaggugaacccacuagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaagcugaugagaucugugagcugcuugauggggaaauugauggauaggggaaggcaagugauccaugaagaaauaggggagaauagagagggcaaccaagaugaugucaggaucgagauggcaaggccuagaaggguaaggcacuggauguacucaccugucauccugacuauucuagcaauugggcuugcugagggcugcgaugagaugguccaugcagauucuaaacuuguuucguguaagcaagggggcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuuuguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucagccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguugauggcagcuacaugcagacauaucacaguucuguacccacaggggcaaauaucccaagcccaacagacuggcugaaugcccuguuuggcaaugggcugaguagguggauucuggggguuauagggguucuacuggggggauuggcucucuuuuucuuaaucaugucuuuguucaaacugggaacgaaacaaguauuucguucaaggacgaagcuggcuuag

SEQ ID NO: 4791 - RNA, 3222 nt, Artificial Sequence
  derived and/or modified CDS sequence (wt) from SFTSV(SPL010A)__AB817991.1__GP
augaugaaagucaucugguucuccucucugaucugcuuagucauccaaugcaguggggauacgggcccaaucauaugcgcagggcccauccacucaaacaagagugcuaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaagcaaucgggguuugggggucaugggucauagcuccagugaagcuaauguuugccaucauaaagaaacugaugagaucugugagcugcuugauggggaaauugauggauaggggaaggcaagugauccaugaagaaauaggagagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacagcaccagggaguccggacucaaaaugucucaaaaucaaaguuaaaaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacaaccauaagagggucuuuuucgguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguccuacuggggggauuggcucucuuuuucuuaaucaugucuuuguucaaacugggaacaaaacagguauuucgaucaaggacgaagcuggcuuag

SEQ ID NO: 4792 - RNA, 3222 nt, Artificial Sequence
  derived and/or modified CDS sequence (wt) from SFTSV(SPL030A)__AB817992.1__GP
augaugaaagucaucugguucuccucucugaucugcuuagucauucaaugcaguggggauacgagcccaaucauaugcgcagggcccauccacucaaacaagagugccagcauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacuuuugauggauacguuggcuggggcuguggcagugggaagucaaggacugagucaggggagcucugcagcucagacucagggaccaguuccggucuucugcccucagauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagccccuugauguugcuuggauggauguuggccacucucauaaaaucaucaugagggagcacaagaccaaaugggugcaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaagugcagaugcucacuagugcacaagcccggggaaguuguugugucauauggagggaugcgugucagaccaaagugcuaugguuucuccagaaugauggcaacacuagaggugaacccaccagagcuaaggauuggccaaugcaccggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcugcucaccaauguccuuaaggcaaucgggguuugggggucaugggucauagcuccagugaagcuaauguuugccaucauaaagaaacugaugagaucugugagcugcuugauggggaaauugauggauaggggaaggcaaguaauccaugaagaaauaggggagaauagagagggcaaccaagaugaugucaggaucgagauggcaaggccuagaaggguaaggcacuggauguacucaccugucauccugaccauucuagcaauugggcuugcugagggcugcgaugagaugguccaugcagauucuaaacuuguuucguguaagcaagggggcggaaauaugaaggaaugugucacaacugggagggcgcuccuuccugcggugaacccaggacaagaggcaugucugcacuucacagcaccagggaguccggacucaaaaugucucaaaaucagaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaauagugaggaaagugcccguaccauaaaaaaagauggguguauauggaaugcugaccucgugggcaucgagcuacgaguggaugacgcugugugcuacucuaagaucacuaguguggaggcaguugcaaacuacucagccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaaguuuccaucaaacugcauagcagcaaaaauagcacugcacacguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguugauggcagcuacaugcagacauaucacaguucuguacccacaggggcaaauaucccaagcccaacagacuggcugaaugcccuguuuggcaaugggcugaguagguggauucuggggguuauagggguucuacuggggggauuggcucucuuuuucuuaaucaugucuuuguucaaacugggaacgaaacaaguauuucgaucaaggacgaagcuggcuuag

SEQ ID NO: 4793 - RNA, 3222 nt, Artificial Sequence
  derived and/or modified CDS sequence (wt) from SFTSV(SPL053A)__AB985292.1__GP
augaugaaagucaucugguucuccucucugaucugcuuagucauccaaugcaguggggauacgggcccaaucauaugcgcagggcccauccacucaaacaagggugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcaucucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauagcucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4794 - RNA, 3222 nt, Artificial Sequence
  derived and/or modified CDS sequence (wt) from SFTSV(SPL054A)__AB985293.1__GP
augaugaaagucaucugguucuccucucugaucugcuuagucauucaaugcaguggggacacgggcccaaucauaugcgcagggcccauccacucaaacaagagugccaacauaccccaccugcuugguuacucugagaagauuugucagauagaucggcugauacaugucucgucaugguugagaaaccacucacaauuucagggcuacguggggcagcgagguggacgcucucaggugaguuacuucccagcugaaaacucuuacucaagguggaguggacuucuaagccccugugaugcugauuggcuugggaugcuuguugugaagaaggccaaggggucugauaugauaguuccugggccuucauacaaggggaaagucuuuuuugaacggccaacuuuugauggauauguaggcuggggcuguggcagugggaagucaaggacugagucaggagagcucugcaguucagacucagggaccaguucaggucuucugcccucagauaggguucucuggauaggugauguugcuugccagccuaugacacccaucccugaagagacauuuauggagcugaagaguuuuagccagagugaauucccagacauaugcaaaauugauggcauuguguucaaccagugugagagugagagccuaccucaacccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacaugcaagaccaguggaucaugcaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucucaagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucaucauugucauccuccuuggauaugcaggccucaugcuacucaccaauguccuuaaggcaaucgggguuugggggucaugggucauagcuccagugaagcuaauguuugccaucauaaagaaacugaugagaucugugaguugccugauggggaaauugauggauaggggaaggcaagugauccaugaagaaauaggggagaauggagagggcaaccaagaugauguuaggaucgagauagccaggcccagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacggcaccagggaguccggacucaaaaugucucaaaaucaaaguuaagaggauuaaccugaaaugcaagaagucaucaucauauuucguuccugaugcucgguccaggugcacaucugugaggagaugccgcugggcaggagacugucagucugggugccccucucauuucacauccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagacauggaggugucuggcuugacugaccugugugaaauagaagagcucaaauccaagaagcuggcauuagcucccugcaaucaggcuggcauggggguuguaggcaagguuggagagauacagugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagucucaguuuugaccaugcaguggucgaugagcagugccagcugaacuguggaggacaugagagucaagugacucuaaaaggcaaccucaucuuccuggaugucccaagauuuguagauggcagcuacaugcaaacauaucauaguucugugcccacaggagcaaauaucccaagcccuacagacuggcugaaugcccuguuuggcaaugggcugaguagguggauucugggggugauagggguucugcuggggggguuggcucucuuuuucuuaauuauguccuuguucaaacugggaacaaaacagguguuucgaucaaggacgaagcuggcuuag

SEQ ID NO: 4795 - RNA, 3222 nt, Artificial Sequence
  derived and/or modified CDS sequence (wt) from SFTSV(SPL055A)__AB985294.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagguggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4796 - RNA, 3222 nt, Artificial Sequence
  derived and/or modified CDS sequence (wt) from SFTSV(SPL057A)__AB985295.1__GP
augaugaaagucaucugguucuccucucugaucugcuuagucauucaaugcaguggggauacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcagcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuccuggagcugaagaguuuuagccagagugaauucccagacauauguagaauugauggcauuguguuuaaccagugugagagugagagucuaccucaacccuuugauguugcauggauggauguaggccacucucauaaaaucaucaugagggagcacaagaccaaaugggugcaagagagcucuucuaaggauuuugugugcuacaaggaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagcccggggaaguuguugugucauauggagggaugcgugucaggccaaaguguuaugguuucuccagaaugauggcaacacuagaggugaacccaccagagcaaaggauuggccaaugcacuggcugccaucuagaguguguaaaugggggugugaggcuaaucacucuaacuagugagcucaagucagcuacugucugugcuucccacuuuuguaguucugccauaaguggcaagaaaagcacagagauucaauuccacucagggucauuaguugggaaaacagcaauacacgucaaaggggcuuugguggauggaacugaauucacauuugagggcaguugcauguucccagaugguugugacgcaguggacugcacguucugucgugaguuucuaaaaaauccucaguguuacccugcaaagaaaugguuguucaucauuauugucauccuccuuggauaugcaggccucaugcuacucaccaauguccucaaggcaaucgggguuuggggaucaugggucauagcuccagugaagcuaauguuugccaucaugaagaaacugaugagaucugugagcugcuugauggggaaauuaauggauaggggaaggcaagugauccaugaggaaauaggggagaauagagagggcaaccaagaugauguuaggaucgagauggcaagacccagaagggugaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcggugaacccagggcaagaggcaugucugcacuucacggcaccugggaguccggacucaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacauccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaauccacaugggaucaucuggaaaguaucuccaugugcugcauggguuccaucagcagucauagagcuaacaaugcccucaggggaagugaggacauuccacccuaugagcggcauccccacacagguuuucaagggugugagugugacuuacuuaggcucagauauggaggugucuggcuugacugaccugugugagauagaagagcucaagucuaagaagcuggcauuagcccccugcaaucaggcugguauggggguuguaggcaagguuggagagauacagugcaguagcgaggaaagugcccgcaccauaaaaaaagauggguguauauggaaugcagaccuugugggcauagaacuacgaguggaugacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugaguggguguuacucuugcaugacaggcgccaaagucuccaucaaacugcauagcaacaaaaauagcacugcccauguaagaugcaaaggggaugagacugcguucagcguccuggagggaguucauagcuauacugucagucucagcuuugaccaugcaguggucgaugagcagugccagcugaacuguggggggcaugagagucaagugacucuaaaaggcaaucucaucuuucuggaugucccaaaauuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggacgaagcuggcuuag

SEQ ID NO: 4797 - RNA, 3222 nt, Artificial Sequence
  derived and/or modified CDS sequence (wt) from SFTSV(SPL062A)__AB985297.1__GP
augaugaaagucaucugguucuccucucugaucugcuuagucauucgaugcagugggggcacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccagggggucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagaguuuuagccagagugaauucccagacauaugcaaaauugaugguauuguguucaaccagugugaaagugagagccuaccucagcccuuugauguugcuuggauggauguuggccacucucauaaaaucaucaugagggagcacaagaccaaauggguucaagagagcucaucuaaggauuuugugugcuacaaggaagggacugggccguguucugaaucagaagaaaagacuugcaagaccaguggaucauguaggggggacaugcaguuuugcaagguggcagguugugaacauggagaagaggcaucugaagccaaaugcagaugcucacuagugcacaagcccggggaaguuguugugucauauggagggaugcgugucagaccaaagugcuauggcuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucucacuuuuguaguucugccacaaguggcaagaaaagcacggagauucaauuccacucagggucuuuaguugggaaaacagcaauacacgucaaaggggcauugguggauggaacugaauucacauuugaggguaguugcauguucccagaugguugugacgcaguggacugcacauucugucgugaguuucuaaaaaauccucagugcuacccugcaaagaaaugguuguucaucauuauugccauccuccuuggauaugcaggccucaugcuacucaccaauguccuuaaggcaaucgggguuugggggucaugggucauagcuccaguaaaguuaauguuugccaucauaaagaaacugaugagaucugugagcugcuugauggggaaguugauggauaggggaaggcaagugauccaugaagagauaggagagaauagagagggcaaccaagaugauguuaggaucgagauggcgaggccuagaaggguaaggcacuggauguacucaccugucauccugacuauucuagcaauugggcuugcugagggcugcgaugagaugguccaugcagauucuaaacuuguuucgugcaagcaagggagcgggaauaugaaggaaugugucacaacugggagggcgcuccuuccugcggugaacccaggacaagaggcaugucugcacuucacggcaccagggaguccggacucaaaaugucucaaaaucaaaguuaagaggauuaaccugaagugcaagaagucaucaucauauuucgucccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaaguaaggacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcuguaugcuacucuaagaucacuaguguggaggcaguugcuaacuacucugccauacccaccacuauugggggucugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacagcacauguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguagauggcagcuacaugcagacauaucauagcucugugcccacaggagcaaauaucccaagcccuacagacuggcugaaugcccuguuuggcaaugggcugaguagguggauucugggggugauagggguucuacuggggggauuggcucucuuuuucuuaaucaugucuuuauucaaacugggaacaaaacagguauuucgaucaaggacgaagcuggcuuag

SEQ ID NO: 4798 - RNA, 3222 nt, Artificial Sequence
  derived and/or modified CDS sequence (wt) from SFTSV(SPL066A)__AB985298.1__GP
augaugaaagucaucugguucuccucucugaucugcuuagucauucaaugcaguggggaugcgagcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacuuuugauggauacguuggcuggggcuguggcagugggaagucaaggacugagucaggggagcucugcagcucagacucagggaccaguuccggucuucugcccucagauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacaugcaagaccaguggaucaugcaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucucaaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaagugguaagaaaagcacggagauucaauuccacucagggucauuaguugggaaagcagcaauacaugucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugauaagaucugugaguugccugauggggaaauugauggauaggggaaggcaagugauccaugaagaaauaggggagaauggagagggcaaccaagaugauguuaggaucgagauggccaggcccagaaggguaaggcacuggauguacucaccugucauccugacuauucuagcaauuggacuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacggcaccagggaguccggacucaaaaugucucaaaaucaaaguuaagagaauuaaccugaaaugcaagaagucaucaucauauuucguuccugaugcucgguccaggugcacaucugugaggagaugccgcugggcaggagacugucagucugggugccccucucauuucacauccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacacaaaucuucaagggugugagugugacuuacuugggcucagacauggaggugucuggcuugacugaccugugugaaauagaagagcucagauccaagaagcuggcauuagcucccugcaaucaggcuggcauggggguuguaggcaagguuggagagauacagugcagcagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauaccuaccacuauugggggacugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagucucaguuuugaccaugcaguggucgaugagcagugccagcugaacuguggaggacaugagagucaagugacucuaaaaggcaaccucaucuuccuggaugucccaaaauucguagauggcagcuacaugcagacauaucauaguucugugcccacaggagcaaauaucccaagcccuacagacuggcugaaugcccuguuuggcaaugggcugaguagguggauucugggggugauagggguucuacuggggggauuggcucucuuuuucuuaaucaugucuuuguucaaacugggaacaaaacagguguuucgaucaaggacgaagcuggcuuag

SEQ ID NO: 4799 - RNA, 3222 nt, Artificial Sequence
  derived and/or modified CDS sequence (wt) from SFTSV(SPL070A)__AB985301.1__GP
augaugaaagucaucugguucuccucucugaucugcuuagucauucaaugcaguggggacacgggcccaaucauaugcgcagggcccauccauucaaacaagagugccaacauaccccaccugcuugguuacucugagaagauuugucagauagaucggcugauacaugucucgucaugguugagaaaccacucacaauuucagggcuacguggggcagcgagguggacgcucucaggugaguuacuucccagcugaaaacucuuacucaagguggaguggacuucuaagccccugugaugcugauuggcuugggaugcuuguugugaagaaggccaaggggucugauaugauaguuccugggccuucauacaagggaaaagucuuuuuugaacggccaacuuuugauggauauguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuuauggagcugaagaguuuuagccagagugaauucccagacauaugcaaaauugauggcauuguguucaaccagugugagagugagagccuaccucaacccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacaugcaagaccaguggaucaugcaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucucaagaaugauggcaacacuagaggugagcccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugauggaugggacugaauucacauuugagggcaguugcauguucccagaugguugugacgcaguggacugcacauucugucgugaguuucuaaaaaauccucagugcuacccugcaaagaaaugguuguucaucaucauugucauccuccuuggauaugcaggccucaugcuacucaccaauguccuuaaggcaaucgggguuugggggucaugggucauagcuccagugaagcuaauguuugccaucauaaagaaacugaugagaucugugaguugccugauggggaaauugauggauaggggaaggcaagugauccaugaagaaauaggggagaauggagagggcaaccaagaugauguuaggaucgagauggccaggcccagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacggcaccagggagcccggacucaaaaugucucaaaaucaaaguuaagaggauuaaccugaaaugcaagaagucaucaucauauuucguuccugaugcucgguccaggugcacaucugugaggagaugccgcugggcaggagacugucagucugggugccccucucauuucacauccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagacauggaggugacuggcuugacugaccugugugaaauagaagagcucaaauccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagucucaguuuugaccaugcaguggucgaugagcagugccagcugaacuguggaggacaugagagucaagugacucuaaaaggcaaccucaucuuccuggaugucccaaaauuuguagauggcagcuacaugcagacauaucauaguucugugcccacaggagcaaauaucccaagcccuacagacuggcugaaugcccuguuuggcaaugggcugaguagguggauucugggggugauagggguucugcuggggggguuggcucucuuuuucuuaaucauguccuuguucaaacugggaacaaaacagguguuucgaccaaggacgaagcuggcuuag

SEQ ID NO: 4800 - RNA, 3222 nt, Artificial Sequence
  derived and/or modified CDS sequence (wt) from SFTSV(SPL071A)__AB985302.1__GP
augaugaaagucaucugguucuccucucugaucugcuuaaucauucaaugcaguggggacacgggcccaaucauaugcgcagggcccauccacucaaacaagagugccaauauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacuuuugauggauacguuggcuggggcuguggcagugggaagucaaggacugagucaggagagcucugcagcucagacucagggaccaguuccggucuucugcccucugauaggguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagagacaucugaagccaaaugcagaugcucacuagugcacaagcccggggaaguuguugugucauauggagggaugcgugucagaccaaaaugcuaugguuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacucaccugucauccuggcuauucuagcaauugggcuugcugagggcugcgaugagaugguccaugcagauucuaaacuuguuucgugcaagcaagggagcggaaauaugaaggaaugugucacaacugggagagcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucgggggaagugaggacauuccaccccaugagcggcaucccuacucaagucuucaagggugugagugugacuuacuugggcucagauauggagguaucuggcuugacugaucugugugaaauagaagagcucaaguccaagaagcuggcauuagcucccugcaaucaggcuggcauggggguuguaggcaagguuggagagauacagugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucauuuucaguuaacuauagaggccuucggcugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4801 - RNA, 3222 nt, Artificial Sequence
  derived and/or modified CDS sequence (wt) from SFTSV(SPL077A)__AB985304.1__GP
augaugaaagucaucugguucuccucucugaucuguuuagucacucaaugcaguggggauacgggcccaauaauaugcgcagggcccauccacucaaacaagagugccaacauaccccaucugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguucuggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaaaccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauacgcaggccucaugcuacucaccaauguccuuaaggcaaucgggguuugggggucaugggucauagcuccagugaagcuaauguuugccauccuaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugucgcugggcuggggacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggugccaucagcagucauagagcuuacaaugcccucaggggaagugaggacauuccaccccaugagcagcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccaccauugggggacugagguuugagagaagccaugacagccaggguaaaauaucugguagccccuuggacaucacagccauaagagggucuuuuucaguuaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacuguggggggcaugagagucaagugacucugaaaggcaaccucaucuuccuggaugucccaaaauucguagauggcagcuacaugcagacauaucauaguucugugcccacaggagcaaauaucccaagcccuacggacuggcugaaugcccuguuuggcaaugggcugaguagguggauucugggggugauagggguucuacuggggggguuggcucucuuuuucuuaaucaugucuuuguucaaacagggaacaaaacagguauuucgaucaaggacgaagcuggcuuag

SEQ ID NO: 4802 - RNA, 3222 nt, Artificial Sequence
  derived and/or modified CDS sequence (wt) from SFTSV(SPL084A)__AB985307.1__GP
augaugaaagucaucugguucuccucucugaucuguuuagucauucaaugcaguggggauacgggcccaauaauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacuccagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguucuggucuucugcccucagauaggguucucuggauaggugauguugcuugccagccuaugacacccaucccugaagagacauuucuggagcugaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaaaccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauacacaggccucaugcuacucaccaauguccuuaaggcaaucgggguuugggggucaugggucauagcuccagugaagcuaauguuugccauccuaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaacaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugucgcugggcuggggacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugagaacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccaggagggaguucauagcuauacugucagccucaguuuugaccaugcaguggucgaugagcagugccagcuaaacuguggggggcaugagagucaagugacucugaaaggcaaccucaucuuccuggaugucccaaaauucguagauggcagcuacaugcagacauaucauaguucugugcccacaggagcaaauaucccaagcccuacggacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4803 - RNA, 3222 nt, Artificial Sequence
  derived and/or modified CDS sequence (wt) from SFTSV(SPL086A)__AB985308.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaggagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacccaccagagcaaaggauuggccaaugcacuggcugccaucuagaaugcauaaaugggggugugagacuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4804 - RNA, 3222 nt, Artificial Sequence
  derived and/or modified CDS sequence (wt) from SFTSV(SPL087A)__AB985309.1__GP
augaugaaagucaucugguucuccucucugaucugcuuagucauucaaugcaguggggacucgggcccaaucaucugugcaggacccauccacucaaacaagagugcugacauaccacaccugcuugguuacucugagaagaucugucagauagaucggcugauucauguaucgucauggcucaggaaccacucacaauuucagggcuacguagggcagcgagguggucgcucucaggugagcuacuacccggcugaaaauucuuacucaagguggaguggacuucuaagucccugugaugcugauuggcuugggaugcuugucgugaagaaggccaaggggucugacaugauagucccugggccuucauacaagggaaaagucuuuuuugaacggccaacuuuugauggguauguaggauggggcuguggcagugggaagucuaggucugagucaggagagcucugcaguucagacucagggacuaguucuggucuucugcccucggauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucagcccuuugauguugcauggauggauguuggccacucacauaagaucaucaugagggagcacaaaaccaaauggguacaagagagcucauccaaggauuucguguguuacaaggaagggacugggccuuguucugaaucugaagaaaagacuugcaagaccaguggaucaugcaggggggacacacaguuuugcaagguggcagguugugaacauggggaagaggcaucugaagccaaguguagaugcucacuugugcacaagcccggggaaguuguugugucauauggagggaugcgugucagaccaaagugcuaugguuucuccagaaugauggcaacacuagaggugagcccaccagagcaaaggauuggucaaugcacuggcugccaucuagaaugcaucaaugggggugugaggcuaaucacucuaaccagugagcuuaagucagcaacugucugugcuucccacuuuugcaguucugccacaagugguaagaaaagcacagagauucaauuccacucaggaucauugguugggaaaacagcaauacacgucaaaggggcauugguagauggaacugaauucacauuugaggguaguugcauguucccagaugguugugaugcaguggacugcacauucugucgugaguuucuaaaaaauccucagugcuacccugcaaagaaguggcuguucaucaucauugucauccuacuuggguaugcaggccucaugcuacucaccaauguccucaaggcaauugggguuuggggaucaugggucauagcuccagugaagcuaauguuugccaucauaaagaaacuaaugagaacugugagcugcuugauggggaaauugauggacaggggaaggcaggugauccaugaggaaauaggggagaauagagagggaaaccgagaugauauuagaaucgagauggcaaggcccagaaggguaaggcauuggauguacucaccugucauccuaacuauucuagcuauagggcuugcugagggcugugaugagaugguccaugcugauuccaagcuuguuucaugcaggcaagggagcggaaauaugaaggaaugugucacaacugggagggcgcuucuucccgcagugaacccaggacaagaggcgugucugcacuucacggcaccugggaguccagacucaaaaugccucaaaauuaaaguuaagaggaucaaccuaaaauguaagaagucaucaucauauuuuguuccugaugcccgguccagguguacaucagugaggagaugucguugggcaggagacugccaaucugggugccccccucauuucacauccaacuccuuuucugaugacugggcagguaagauggacagggcuggucuaggauucaguggcugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuaacaaugcccucaggggaagugaggacauuccaccccaugagcggcauccccacacaggucuucaagggugugaguguuacuuacuugggcucagauauggaggugucuggcuugacugaccugugugagauagaagagcucaaguccaagaagcuggcacuagcucccugcaaccaggcuggcauggggguuguaggcaagguuggagagauacagugcagcagcgaggaaagugcccguaccauaaagaaagaugggugcauauggaaugcugaccucguggguauugagcuacgaguggaugacgcagugugcuacucuaagaucacuaguguggaggcaguugcaaacuacucugccauacccaccacuauuggggggcugagguuugagaggagccaugacagccaagguaaaauaucugguagcccccuggacaucacagcuauaagagggucguuuucuguuaauuauagaggccuucgacugagucucucagaaauuacugcuaccugcacaggggaggugacaaaugugaguggguguuauucuugcaugacgggcgccaaagucuccaucaaauugcauagcagcaaaaauaguacugcccauguaagaugcaaaggggaugagacagcauucagugucuuagagggaguccauagcuacacugucagucucaguuuugaccaugcgguggucgaugagcggugccaguugaacuguggggggcaugagagucaagugacucuaaaaggcaaccucaucuuccuggaugucccaaaauuuguggaugguagcuacaugcaaacauaucacaguacugugcccacaggggcaaauauuccaagcccaacagauuggcugaaugccuuguuuggcaaugggcugaguagguggauccuaggggugauagggguucuacuggggggauuggcucucuuuuucuuaaucaugucuuuguucaagcugggaacaaaacagguauuucgaucgaggacgaagcuggcuuag

SEQ ID NO: 4805 - RNA, 3222 nt, Artificial Sequence
  derived and/or modified CDS sequence (wt) from SFTSV(SPL090A)__AB985311.1__GP
augaugaaagucaucugguuccccucucugaucugcuuagucauucgaugcagugggggcacgggcccaaucauaugcgcagggcccauccacucaaacaagagugccaacauaccccaccugcuugguuacucugagaagauuugucagauagaucggcugauacauguuucgucaugguugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccagggggucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagaguuuuagccagagugaauucccagacauaugcaaaauugaugguauuguguucaaccagugugaaagugagagccuaccucagcccuuugauguugcuuggauggauguuggccacucucauaaaaucaucaugagggagcacaagaccaaauggguucaagagagcucauccaaggacuuugugugcuacaaggaagggacugggccguguucugaaucagaagaaaagacuugcaagaccaguggaucauguaggggggacaugcaguuuugcaagguggcagguugugaacauggagaagaggcaucugaagccaaaugcagaugcucacuagugcacaagcccggggaaguuguugugucauauggagggaugcgugucagaccaaagugcuauggcuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucucacuuuuguaguucugccacaaguggcaagaaaagcacggagauucaauuccacucagggucuuuaguugggaaaacagcaauacacgucaaaggggcauugguggauggaacugaauucacauuugaggguaguugcauguucccagaugguugugacgcaguggacugcacauucugucgugaguuucuaaaaaauccucagugcuacccugcaaagaaaugguuguucaucauuauugccauccuccuuggauaugcaggccucaugcuacucaccaauguccuuaaggcaaucgggguuugggggucaugggucauagcuccaguaaaguuaauguuugccaucauaaagaaacugaugagaucugugagcugcuugauggggaaguugauggauaggggaaggcaagugauccaugaagagauaggagagaauagagagggcaaccaagaugauguuaggaucgagauggcgaggccuagaaggguaaggcacuggauguacucaccugucauccugacuauucuagcaauugggcuugcugagggcugcgaugagaugguccaugcagauucuaaacuuguuucgugcaagcaagggagcgggaauaugaaggaaugugucacaacugggagggcgcuccuuccugcggugaacccaggacaagaggcaugucugcacuucacggcaccagggaguccggacucaaaaugucucaaaaucaaaguuaagaggauuaaccugaaaugcaagaagucaucaucauauuuugucccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcuguaugcuacucuaagaucacuaguguggaggcaguugcuaacuacucugccauacccaccacuauugggggucugagguuugagagaagccaugacagccaggguaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcugaacugugggggacaugagagucaagugacucuaaaaggcaaccucaucuuccuggaugucccaaaauucguagauggcagcuacaugcagacauaucauagcucugugcccacaggagcaaauaucccaagcccuacagacuggcugaaugcccuguuuggcaaugggcugaguagguggauucugggggugauagggguucuacuggggggauuggcucucuuuuucuuaaucaugucuuuauucaaacugggaacaaaacagguauuucgaucaaggacgaagcuggcuuag

SEQ ID NO: 4806 - RNA, 3222 nt, Artificial Sequence
  derived and/or modified CDS sequence (wt) from SFTSV(SPL097A)__AB985312.1__GP
augaugaaagucaucugguucuccucucugaucugcuuagucauucaaugcaguggggauacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcagcgaggugggcgcucacagguaagcuacuacccagcugaaaacucuuacucaagguggaguggacuucuaagccccugugaugcugauuggcuugggaugcuuguugugaagaaggccaaagggucugauaugauaguuccugggccuucauacaaggggaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagcccaugacacccaucccugaagagacauuucuggagcugaagaguuuuagccagagcgaauucccagacauaugcaaaauugauggcauuguguuuaaccagugcgagagugagagucuaccucaacccuuugauguugcauggauggauguaggccacucucauaaaaucaucaugagggagcacaagaccaaaugggugcaagagagcucuucuaaggauuuugugugcuacaagcaagggacugggccguguccugaaucagaagaaaagacuugcaagaccagugggucaugcaggggggacaugcaguuuugcaagguggcagguugugagcauggggaagaggcaucugaagccaaguguagaugcucacuagugcacaagcccggggaaguuguugugucauauggagggaugcgugucaggccaaaguguuaugguuucuccagaaugauggcaacacuagaggugaacccaccagagcaaaggauuggccaaugcacuggcugccaucuagaauguguaaaugggggugugaggcuaaucacucuaacuagugagcucaagucagcuacugucugugcuucccacuuuuguaguucugccacaaguggcaagaaaaacacagagauucaauuccacucagggucauuaguugggaaaacagcaauacacgucaaaggggcuuuguuggauggaacugaauucacauuugagggcaguugcauguucccagaugguugugacgcaguggacugcacguucugucgugaguuucuaaaaaauccucagugcuacccugcaaagaaaugguuguucaucauuauugucauccuccuuggauaugcaggccucaugcuacucaccaauguccuuaaggcaaucgggguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaagaccuagaaggguaaggcauuggauguacucaccugucauccugacuauucuagcaguugggcuugcugagggcugcgaugagaugguccaugcagauucuaagcuuguuucgugcaagcaagggagcggaaauaugaaggaaugugucacaacugggagggcgcuccuuccugcgguaaacccagggcaagaggcaugucugcacuucacggcaccugggaguccggacucaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacguccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcaugggucccaucagcagucauagagcuaacaaugcccucaggggaagugaggacauuccaccccaugagcggcaucccuacacaggucuucaagggugugagugugacuuacuuaggcucagauauggaggugucuggcuugacugaccugugugagauagaagagcucaagucuaagaaacuggcauuagcccccugcaaucaggcuggcauggggguuguaggcaagguuggagagauacagugcaguagcgaggaaagugcccgcaccauaaaaaaagauggguguauauggaaugcugaccuugugggcauagaacuacgaguggaugacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacaugcacaggagaggugacaaaugugaguggguguuacucuugcaugacaggcgccaaagucuccaucaaacugcauagcaacaaaaauagcacugcccauguaaggugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaguuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucucuguucaaauugggaacuaaacagguauuucgaucaaggacgaagcuggccuag

SEQ ID NO: 4807 - RNA, 3222 nt, Artificial Sequence
  derived and/or modified CDS sequence (wt) from SFTSV(SPL100A)__AB985313.1__GP
augaugaaagucaucugguucuccucucugaucugcuuagucauucaaugcaguggggauacgggcccaaucauaugcgcaggacccauccacucaaacaagagugccgacauaccccaccugcuugguuacucugagaagauuugucagauagaucggcugauacauguuucgucauggcugagaaaccauucacaauuucagggcuacguggggcagcgaggugggcgcucacagguaagcuacuacccagccgaaaacucuuacucaagguggaguggacuucuaagccccugugaugcugauuggcuugggaugcuuguugugaagaaggccaaagggucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguucaggucuucugcccucagauaggguucucuggauaggugauguugcuugccagccuaugacacccaucccugaagagacauuucuggagcugaagaguuucagccagagcgaauucccagacauaugcaaaauugauggcauuguguuuaaccagugcgagagugagagucuaccucaacccuuugauguugcauggauggauguaggccacucucauaaaaucaucaugagggagcacaagaccaaaugggugcaagagagcucuucuaaggauuuugugugcuacaagcaagggacugggccguguucugaaucagaagaaaagacuugcaagaccagugggucaugcaggggggacaugcaguuuugcaagguggcagguugugagcauggggaagaggcaucugaagccaaguguagaugcucacuagugcacaagcccggggaaguuguugugucauauggagggaugcgugucaggccaaaguguuaugguuucuccagaaugauggcaacacuagaggugaacccaccagagcaaaggauuggccagugcacuggcugccaucuagaauguguaaaugggggugugaggcuaaucacucuaacuagugagcucaagucagcuacugucugugcuucccacuuuuguaguucugccacaaguggcaagaaaagcacagagauucaauuccacucagggucauuaguugggaaaacagcaauacacgucaaaggggcuuuguuggauggaacugaauucacauuugagggcaguugcauguucccagaugguugugacgcaguggacugcacguucugucgugaguuucuaaaaaauccucagugcuacccugcaaagaaaugguuguucaucauuauugucauccuccuuggauaugcaggccucaugcuacucaccaauguccuuaaggcaaucgcgguuuggggaucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaagaccuagaaggguaaggcauuggauguacucaccugucauccugacuguucuagcaguugggcuugcugagggcugcgaugagaugguccaugcagauucuaagcuuguuucgugcaagcaagggagcggaaauaugaaggaaugugucacaacugggagggcgcuccuuccugcgguaaacccagggcaagaggcaugucugcacuucacggcaccugggaguccggacucaaaaugucucaaaauuaagguuaagaagauuaaucuaaaauguaagaagucaucaucauauuuugucccugaugcucggucuagguguacaucugugaggagaugucgcugggcaggagacugccagucugggugccccucucauuucacguccaacuccuuuucugaugauugggcagguaaaauggacagggcuggucuaggauucagugggugcucugauggauguggaggagcagccugcggcugcuuuaaugcagccccuucaugcaucuuuuggaggaaauggguagagaacccacaugggaucaucuggaaaguaucuccaugugcugcaugggucccaucagcagucauagagcuaacaaugcccucaggggaagugaggacauuccaccccaugagcggcaucccuacacaggucuucaagggugugagugugacuuacuuaggcucagauauggaggugucuggcuugacugaccugugugagauagaagagcucaagucuaagaaacuggcauuagcccccugcaaucaggcugguauggggguuguaggcaagguuggagagauacagugcaguagcgaggaaagugcccgcaccauaaaaaaagauggguguauauggaaugcugaccuugugggcauagaacuacgaguggaugacgcugugugcuacucuaagaucacuaguguggaggcaguugcaaacuacucugccauacccaccacuauuggggggcugagguuugagagaagccaugacagccaggguaagauaucugguagcccccuagacaucacagccauaagaggguccuuuucaguuaauuauagaggccuucgacuaagccucucagaaauuacugcaacuugcacaggagaggugacaaaugugaguggguguuacucuugcaugacaggcgccaaagucuccaucaaacugcauagcaacaaaaauagcacugcccauguaaggugcaaaggggaugagacugcguucagcguccuggagggaguucauagcuauacugucagucucagcuuugaccaugcaguggucgaugagcagugccagcugaacuguggggggcaugagagucaagugacucuaaaaggcaaccucaucuuucuggaugucccaaaguuuguagauggcagcuauaugcagacauaucauaguucuguacccacaggggcuaauaucccaagcccuacagacuggcugaaugccuuguuuggcaaugggcugaguagguggauucugggggugauagggguucuacuggggggauuggcucucuuuuucuuaaucaugucuuuguucaaauugggaacuaaacagguauuucgaucaaggacgaagcuggcuuag

SEQ ID NO: 4808 - RNA, 3222 nt, Artificial Sequence
  derived and/or modified CDS sequence (wt) from SFTSV(SPL106A)__AB985316.1__GP
augaugaaagucaucugguucuccucucugaucuguuuagucauucaaugcaguggggauacgggcccaauaauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguucuggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaaaccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauacgcaggccucaugcuacucaccaauguccuuaaggcaaucgggguuugggggucaugggucauagcuccagugaagcuaauguuugccauccuaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugaggugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugucgcugggcuggggacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccuaucagaaauuacugcuacuugcacaggggaggugacaaaugugaguggguguuacucuugcaugauaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacuguggggggcaugagagucaagugacucugaaaggcaaccucaucuuccuggaugucccaaaauucguagauggcagcuacaugcagacauaucauaguucugugcccacaggagcaaauaucccaagcccuacggacuggcugaaugcccuguuuggcaaugggcugaguagguggauucugggggugauagggguccuacuggggggauuggcucucuuuuccuuaaucaugucuuuguucaaacugggaacaaaacagguacuucgaucaaggacgaagcuggcuuag

SEQ ID NO: 4809 - RNA, 3222 nt, Artificial Sequence
  derived and/or modified CDS sequence (wt) from SFTSV(SPL117A)__AB985321.1__GP
augaugaaagucaucugguucuccucucugaucugcuuagucauucaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaagggaucugauaugauaguuccugggccuucauacaggggaaaagucuuuuuugaacggccaacuuuugauggauacguaggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcuaaagagcuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaaugggugcaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaagccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaaccagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauaugcaggccucaugcugcucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguggagaauccacaugggaucaucuggaaaguaucuccaugugcugcaugggucccaucagcagucauagagcuuacaaugcccucaggggaagugaggacauuccaccccaugagcggcaucccuacacaagucuucaaaggugugagugugacuuacuugggcucagauauggagguaucuggcuugacugaccucugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccuagugggcaucgagcuacgaguggaugacgcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucagcuuugaccaugcaguggucgaugagcagugccagcuaaacuguggggggcaugagagucaagugacucugaaaggaaaccucaucuuccuggaugucccaaaauucguagauggcagcuacaugcagacauaucauaguucugugcccacaggagcaaauaucccaagcccuacagacuggcugaaugcccuguuuggcaaugggcugaguagguggauucugggggugauagggguucuacuggggggauuggcccucuuuuucuuaaucaugucuuuguucaaacugggaacaaaacagguauuucgaucaaggacgaagcuggcuuag

SEQ ID NO: 4810 - RNA, 3222 nt, Artificial Sequence
  derived and/or modified CDS sequence (wt) from SFTSV(SPL120A)__AB985322.1__GP
augaugaaagucaucugguucuccucucugaucuguuuagucauucaaugcaguggggauacgggcccaauaauaugcgcagggcccauccacucaaacaagagugccaacauaccccaccugcuugguuacucugagaagaucugucagauagaucggcugauacauguuucgucauggcugagaaaccauucacaauuucagggcuacguggggcagcgagguggacgcucucaggugaguuacuucccagcugaaaacucuuacucaagguggagugggcuucuaagccccugugaugcugauuggcuugggaugcuugucgugaagaaggccaagggaucugauaugauaguuccugggccuucauacaagggaaaagucuuuuuugaacggccaacuuuugauggauacguaggcuggggcuguggcagugggaagucaaggacugagucaggagagcucugcagcucagacucagggaccaguucuggucuucugcccucagauaggguucucuggauaggugauguugcuugccagccuaugacacccaucccugaagagacauuucuggagcuaaagaguuuuagccagagugaauucccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucaugcaggggggacaugcaguuuugcaagguggcagguugugaacauggggaagaggcaucugaagccaaaugcagaugcucacuagugcacaaaccuggggaaguuguugugucauauggagggaugcgugucagaccaaagugcuaugguuucuccaggaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacaugucaaaggggcauugguggauggaacugaauucacauuugagggcaguugcauguucccagauggcugugacgcaguggacugcacauucugucgugaguuucuaaaaaauccucagugcuacccugcaaagaaaugguuguucaucauuauugucauccuccuuggauacgcaggccucaugcuacucaccaauguccuuaaggcaaucgggguuugggggucaugggucauagcuccagugaagcuaauguuugccauccuaaagaaacugaugagaucugugagcugcuugauggggaaauugauggauaggggaaggcaagugauccaugaagaaauaggagagaacagagagggcaaccaagaugauguuaggaucgagauggcaaggccuagaaggguaaggcacuggauguacucaccugucauccugacuauucuagcaauugggcuugcugagggcugcgaugaggugguccaugcagauucuaaacuuguuucgugcaagcaagggagcggaaauaugaaggaaugugucacaacugggagggcgcuccuuccugcagugaacccaggacaagaggcaugucugcacuucacggcaccagggaguccggacucaaaaugucucaaaaucaaaguuaagaggauuaaccugaaaugcaagaagucaucaucauauuucguuccugaugcucgguccagguguacaucugugaggagaugucgcugggcuggggacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaacccacaugggaucaucuggaaaguaucuccaugugcugcaugggucccaucagcagucauagagcuuacaaugcccucaggggaagugaggacauuccaccccaugagcggcaucccuacacaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacagugcaguagcgaggaaagugcccguaccauaaaaaaagauggguguauauggaaugcugaccucgugggcaucgagcuacgaguggaugaugcugugugcuacucuaagaucacuaguguggaggcaguugcaaacuacucugccauacccaccacuauugggggacugagguuugagagaagccaugacagccaggguaaaauaucugguagccccuuggacaucacagccauaagagggucuuuuucaguuaauuauagaggccuucgacugagccuaucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcuaaacuguggggggcaugagagucaagugacucugaaaggcaaccucaucuuccuggaugucccaaaauucguagauggcagcuacaugcagacauaucauaguucugugcccacaggagcaaauaucccaagcccuacggacuggcugaaugcccuguuuggcaaugggcugaguagguggauucugggggugauagggguucuacuggggggauuggcucucuuuuccuuaaucaugucuuuguucaaacugggaacaaaacagguauuucgaucaaggacgaagcuggcuuag

SEQ ID NO: 4811 - RNA, 3222 nt, Artificial Sequence
  derived and/or modified CDS sequence (wt) from SFTSV(SPL121A)__AB985323.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaccuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaagucaaaguuaagaggaucaaccugaaaugcaagaagucaucaucauauuucguuccugaugcucgguccagguguacaucugugaggagaugccgcugggcaggagacugucagucugggugccccucccauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauggaagagcucaaguccaagaagcuggcauuagcucccugcaaucaggcuggcauggggguuguuggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4812 - RNA, 3222 nt, Artificial Sequence
  derived and/or modified CDS sequence (wt) from SFTSV(SPL124A)__AB985324.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucagaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugccgcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucauaucuuuguucaaacugggaacaaaacagguauuucgaucaaggacgaagcuggcuuag

SEQ ID NO: 4813 - RNA, 3222 nt, Artificial Sequence
  derived and/or modified CDS sequence (wt) from SFTSV(SPL128A)__AB985325.1__GP
augaugaaagucaucugguucuccucucugaucugcuuagucauccaaugcaguggggauacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaacauuugauggauacguuggcuggggcuguggcagugggaagucaaggacugagucaggagagcucugcagcucagacucagggaccaguuccggucuucugcccucagauaggguucucuggauaggugauguugcuugccagccuaugacacccaucccugaagagacauuucuggagcugaagagcuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccaguggaucauguaggggggacaugcaguuuugcaagguggcagguugugaacauggggaagaggcaucugaagccaaaugcagaugcucacuagugcacaagcccggggaaguuguugugucauauggagggaugcgugucagaccaaagugcuaugguuucuccagaaugauggcaacacuagaggugaacucaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucuaaaaaauccucagugcuacccugcaaagaaaugguuguucaucauuauugucauccuccuuggauaugcaggccucaugcuacucaccaauguccuuaaggcaaucgggguuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaugauguuaggaucgagauggcaaggccuagaaggguaaggcacuggauguacuccccugucauccugacuauucuagcaauugggcuugcugagggcugcgaugagaugguccaugcagauucuaaacuuguuucgugcaagcaagggagcggaaauaugaaggaaugugucacaacugggagggcgcuccuuccugcggugaacccaggacaagaggcaugucugcacuucacagcaccagggaguccggacucaaaaugucucaaaaucagaguuaagaggaucaaccugaaaugcaagaagucaucaucauauuucguuccugaugcucgguccagguguacaucugugaggagaugccgcugggcaggagacugucagucugggugccccucucauuucacguccaacuccuuuucugaugauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugccgcaugggucccaucagcagucauagagcuuacaaugcccucaggggaagugaggacauuccaccccaugagcggcaucccuacucaagucuucaagggugugagugugacuuacuugggcucagauauggagguaucuggcuugacugaccugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauugggggacugagguuugagagaagccaugacagccagggcaaaauaucugguagccccuuggacaucacagccauaagagggucuuuuucaguuaauuauagaggccuucgacugagccucucagaaauuacugcuacuugcacaggggaggugacaaaugugaguggguguuacucuugcaugacaggcgccagggucuccaucaaacugcauagcagcaaaaauagcacugcacauguaaggugcaaaggggaugagacugcguucaguguccuggagggaguucauagcuauacugucagccucagcuuugaccaugcuguggucgaugagcagugccaacugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggcgauagggguucuacuggggggauuggcucucuuuuucuuaaucauaucuuuguucaaacugggaacaaaacagguauuucgaucaaggacgaagcuggcuuag

SEQ ID NO: 4814 - RNA, 3222 nt, Artificial Sequence
  derived and/or modified CDS sequence (wt) from SFTSV(SPL129A)__AB985326.1__GP
augaugaaagucaucugguucuccucucugaucugcuuggucauucaaugcaguggggacacgggcccaaucauaugugcagggcccauccacucaaacaagagugccaacauaccccaccugcuugguuacucugagaagauuugucagauagaucgacugauacauguuucgucauggcugagaaaccauucacaguuucagggcuacguggggcagcgagguggacgcucucaggugagcuacuacccagcugaaaacucuuacucaagguggagcggacuucuaagccccugugaugcugauuggcuugggaugcuugucgugaagaaggccaaggggucugauaugauaguuccuggaccaucauacaaggggaaagucuuuuuugagcggccaacuuuugauggauacgugggcuggggcugugguagugggaagucaaggacagagucaggugaacucugcagcucagacucagggaccaguucuggucuucugcccucagauagaguucucuggauaggugauguugcuugccagccuaugacacccaucccugaggagacauuucuggagcugaagaguuuuagccagagugaauucccagacauaugcaagauugauggcauuguguucaaucagugugagagugagaguuuaccucagcccuuugaugucgcauggauggauguaggucacucucauaaaaucaucaugagggagcacaagaccaaauggguacaagagagcucaucuaaggauuuugugugcuacaaggaaggaacugggccguguucugaaucagaagaaaagacuugcaagaccaguggaucaugcaggggggacaugcaguuuugcaagguggcagguugugaacauggggaagaggcaucugaagccaaguguagauguucucuagugcacaagcccggggaaguuguugugucauauggagggaugcgugucagaccaaaguguuaugguuucuccagaaugauggcaacacuagaggugaacccaccagagcaaaggauuggccaaugcacuggcugccaucuagaaugcauaagugggggugugaggcuaaucacucuaacuagugagcucaagucagccacugucugugcuucccacuuuuguaguucugccacaaguggcaagaaaagcacggagauucaauuccacucagggucauuaguugggaaagcagcaauacacgucaaaggggcuuugguggauggaacugaauucacauuugaggguaguugcauguucccagaugguugugacgcaguggauugcacauucugucgugaguuucuaaagaauccucagugcuacccugcaaagaaaugguuguucauuauuauugucauccuccuuggauaugcaggccucaugcuacucaccaauguccuuaaggcaaucgggguuuggggaucaugggucauagcuccagugaagcuaauguuugccaucaugaagaaacugaugagaucugugagcugcuugauggggaaauugauggauaggggaaggcaagugauccaugaagaaauaggggagaauagagagggcaaccgagaugauguuaggaucgagauggcaagaccgagaagggugaggcauuggauguacucaccugucauccugacuauucuagcaauugggcuagcugagggcugcgaugagaugguccaugcugauucuaaacuuguuucgugcaggcaagggagugggaacaugaaagaaugugucacaacugggagggcgcuccuuccugcggugaacccaggacaagaggcaugucugcacuucacggcaccugggagcccggacucaaaaugucucaagaucaagguuaagaggaucaaccuaaaauguaagaagucaucaucauauuuuguuccugaugcuagauccagguguacaucugugaggagaugucgcugggcaggagacugucagucugggugccccucucauuucacguccaacuccuucucugaugauugggcagguaaaauggacagggcuggucuaggauucagugggugcucugauggaugugggggagcagccugcggcugcuuuaaugcggccccuucaugcaucuuuuggaggaaauggguagagaauccacaugggaucaucuggaaaguaucuccaugugcugcaugggucccaucagcagucauagagcuaacgaugcccucgggggaagugaggacauuccaccccaugaguggcauccccacacaagucuucaagggugugagugugacuuacuuaggcucagauauggaggugucuggcuugacugaccugugugagauagaagagcuaaaguccaagaagcuggcauuagcucccugcaaucaggcuggcauggggguaguaggcaagguuggagagauacagugcagcagcgaggaaagcgcccguacuauaaagaaagaugggugcauauggaaugcugaccuuguaggcauagagcuacggguggaugacgcugugugcuacucuaagaucacuaguguggagacaguugcaaacuacucugccauacccaccacuauuggggggcugagguuugagagaagccaugacagccaggguaaaauaucugguagcccccuagacaucacagccauaagagggucuuuuucaguuaauuauagaggccuucgacugagccucucagaaauuacugccacuugcacuggggaggugacgaaugugaguggguguuacucuugcaugacaggcgccaaagucuccaucaaacugcauagcagcaaaaauagcacugcccauguaagaugcaaagaggaugagaccgcguuuaguguccuggagggaguucauagcuauacugucagucucagcuuugaccaugcaguggucgaugagcagugccagcugaacuguggggggcaugagagucaugugacucuaaaaggcaaccuuaucuuccuggaugucccaaaauuuguagauggcagcuauaugcagacauaucauaguucugugcccacaggggcuaauaucccaagcccgacagacuggcugaaugccuuguuuggcaaugggcugaguagauggauucugggggugauggggguucugcuggggggguuggcucucuucuucuuaaucaugucuuuguucaaacugggaacaaaacagguauuucgaucaaggacgaagcuggcuuag

SEQ ID NO: 4815 - RNA, 3222 nt, Artificial Sequence
  derived and/or modified CDS sequence (wt) from SFTSV(YG1)__AB817987.1__GP
augaugaaagucaucugguucuccucucugaucugcuuagucauucaaugcaguggggacacgggcccaaucauaugcgcagggcccauccacucaaacaagagugccaacauaccccaccugcuugguuacucugagaagauuugucagauagaucggcugauacauguuucgucauggcugagaaaccauucacaauuucagggcuacguggggcagcgagguggacgcucucaggugaguuacuucccagcugaaaacucuuacucaagguggaguggacuucuaagccccugugaugcugauuggcuugggaugcuugucgugaagaaggccaaggggucugauaugauaguuccugggccuucauacaagggaaaagucuuuuuugaacggccaaccuuugauggauacguuggcuggggcuguggcagugggaagucaaggacugagucaggagagcucugcagcucagacucagggaccaguuccggucuucugcccucagauagaguucucuggauaggugauguugcuugccagccuaugacacccaucccugaagagacauuucuggagcugaagaguuuuagccagagugaauuuccagacauaugcaaaauugauggcauuguguucaaccagugugagagugagagccuaccucagcccuuugauguugcuuggauggauguuggccacucucauaaaaucaucaugagggagcacaagaccaaauggguacaagagagcucaucuaaggauuuugugugcuacaaggaagggacugggccguguucugaaucagaagaaaagacuugcaagaccagcggaucauguaggggggacaugcaguuuugcaagguggcagguugugaacauggggaagagacaucugaagccaaaugcagaugcucacuagugcacaagcccggggaaguuguugugucauauggagggaugcgugucagaccaaaaugcuaugguuucuccagaaugauggcaacacuagaggugaacccaccagagcaaaggauuggccaaugcacuggcugccaucuagaaugcauaaaugggggugugaggcuaaucacucuaacuagugagcucaagucagcuacugucugugcuucccacuuuuguaguucugccacaaguggcaagaaaagcacggagauucaauuccacucagggucauuaguugggaaaacagcaauacacgucaaaggggcauugguggauggaacugaauucacauuugagggcaguugcauguucccagaugguugugacgcaguggacugcacauucugucgugaguuucugaaaaauccucagugcuacccugcaaagaaaugguuguucaucauuauugucauccuccuuggauaugcaggccucaugcuacucaccaauguccuuaaggcaaucgggauuugggggucaugggucauagcuccagugaagcuaauguuugccaucauaaagaaacugaugagaucugugagcugcuugauggggaaauugauggauaggggaaggcaagugauccaugaagaaauaggggagaauagagagggcaaccaagaagauguuaggaucgagauggcaaggccuagaaggguaaggcacuggauguacucaccugucauccuggcuauucuagcaauugggcuugcugagggcugcgaugagaugguccaugcagauucuaaacuuguuucaugcaagcaagggagcggaaauaugaaggaaugugucacaacugggagggcgcuccuuccugcggugaacccaggacaagaggcaugucugcacuucacagcaccagggaguccggacucaaaaugucucaaaaucaaaguuaagaggaucaaccugaaaugcaagaagucaucaucauauuucguuccagaugcucgguccagguguacaucugugaggagaugccgcugggcaggagacugucagucugggugccccucucauuucacguccaacuccuuuucugacgauugggcagguaaaauggacagggcuggucuaggauucagugggugcucugauggauguggaggagcagccugcggcugcuuuaaugcggccccuucaugcaucuucuggaggaaauggguagagaauccacaugggaucaucuggaaaguaucuccaugugcugcaugggucccaucagcagucauagagcuuacaaugcccucgggggaagugaggacauuccaccccaugagcggcaucccuacucaagucuucaagggugugagugugacuuacuuaggcucagauauggagguaucuggcuugacugaucugugugaaauagaagagcucaaguccaagaagcuggcauuagcucccugcaaucaggcuggcauggggguuguaggcaagguuggagagauacaaugcaguagugaggaaagugcccguaccauaaaaaaagauggguguauauggaaugcugaccucgugggcaucgagcuacgaguggaugacgcugugugcuacucuaagaucacuaguguggaggcaguugcaaacuacucugccauacccaccacuauuggggggcugagguuugagagaagccaugacagccaaggcaaaauaucugguagccccuuggacaucacagccauaagagggucuuuuucaguuaacuauagaggccuucggcugagccucucagaaauuacugcuacuugcacaggggaggugacaaaugugaguggguguuacucuugcaugacaggcgccaaagucuccaucaaacugcauagcagcaaaaauagcacugcacauguaaggugcaaaggggaugagacugcguucaguguccuggagggaguucauagcuauacugucagccucaguuuugaccaugcaguggucgaugagcagugccagcugaacuguggggggcaugagagucaagugacucuaaaaggcaaccucaucuuccuggaugucccaaaauucguagauggcagcuacaugcagacauaucauaguucuguacccacaggagcaaauaucccaagcccaacagacuggcugaaugcccuguuuggcaaugggcugaguagguggauucugggggugauagggguucuacuggggggauuggcucucuuuuucuuaaucaugucuuuguucaaacugggaacaaaacagguauuucgaucaaggacgaagcuggcuuag

SEQ ID NO: 4816 - RNA, 3222 nt, Artificial Sequence
  derived and/or modified CDS sequence (wt) from SFTSV(SDTA_1)__KX641913.1__GP
augaugaaagucaucugguucuccucucugaucugcuuagucauucaaugcaguggggauucgggcccaaucaucugcgcaggacccauccacucaaacaagagugcuggcauaccccaccugcuuggguacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccagggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagcuuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcggguugcgaacauggagaggagacaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacugaugagaacugugagcugcuugguggggaaauugauggauaggggaaggcaagugauccaugaggaaauaggggagaauggggagggcaaccaagaugauguuaggauugagauugcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggcgaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugaugcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagcggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacagcacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4817 - RNA, 3222 nt, Artificial Sequence
  derived and/or modified CDS sequence (wt) from SFTSV(SDTA_2)__KX641914.1__GP
augaugaaagucaucugguucuccucucugaucugcuuagucauucaaugcaguggggauucgggcccaaucaucugcgcaggaccuauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuugcaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcauaugauuggucaaugcacuggcugccaucuagaaugcauaaaugggggugugaggcuaaucacucuaaccagugagcucaggucagcuacugucugugcuucccacuuuugcaguucugccucaaguggcaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguaguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagagguuccuuuucuguuaacuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaacaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4818 - RNA, 3222 nt, Artificial Sequence
  derived and/or modified CDS sequence (wt) from SFTSV(SDTA_3)__KX641915.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccagugggucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauucaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagguggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcauggguuccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4819 - RNA, 3222 nt, Artificial Sequence
  derived and/or modified CDS sequence (wt) from SFTSV(SDTA_4)__KX641916.1__GP
augaugaaagucaucugguucuccucucugaucugcuuagucauucaaugcaguggggauucgggcccaaucaucugcgcaggacccauccacucaaauaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccagcggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauauucccagauggaugugaugcaguggacugcacauucugucgugaguuucuaaaaaauccucagugcuacccugcaaagaaguggcuguucaucauuauugucauccuccuuggauaugcaggacucauguuacucaccaauguccuuaaggcaauuggggucuggggaucauggguaauagcuccaguaaagcuaauauuugccaucaugaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggggggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcucgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccagggcaagauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguucggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4820 - RNA, 3222 nt, Artificial Sequence
  derived and/or modified CDS sequence (wt) from SFTSV(HBGS13_human_2015)__KY440773.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggccuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguuguuucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggauugcugagagcugugaugagaugguccaugcugauucuaagcuuguuucaugcaggcaagggagcggaaacaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacuaaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuaucauuaucaugucuuuguucaagcugggaacaaaacagguauuucgaucaaggacaaagcuggcuuag

SEQ ID NO: 4821 - RNA, 3222 nt, Artificial Sequence
  derived and/or modified CDS sequence (wt) from SFTSV(HBMC16_human_2015)__KY440776.1__GP
augaugaaagucaucugguucuccucucuggucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuauguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaggagagcucaucuaaggauuuugugugcuacaaggaagggacuggaccuuguucugaaucagaagaaaaggcuugcaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugaggcuaaucacucuaacuagugagcucaagucagcuacugucugugcuucccacuuuugcaguucugccacaagugguaagaaaagcacggagauucauuuccacucaggaucauugguugggaaagcagcuauccaugucaaaggggcauugguagaugggacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauagaggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagagcgcuucuuccugcggugaacccaggacaagaggcgugucugcacuucacggcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcaggcaagauggacagggcuggucuuggauucaguggcugcucugauggauguggaggagcagccugcggaugcuuuaaugcggccccuucaugcaucuucuggaggaaauggguggagaauccacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauugagucucucagaaauuacugccacuugcacaggggaggugacaaaugugaguggguguuauucuugcaugacaggcgccaaagucuccaucaaauugcauagcagcaaaaauagcacugcccauguuagauguaaaggggaugagacugcauucagugucuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacagcacugugcccacaggggcaaauaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4822 - RNA, 3222 nt, Artificial Sequence
  derived and/or modified CDS sequence (wt) from SFTSV(HBMC5_human_2016)__KY440770.1__GP
augaugaaagucaucugguucuccucucuggucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuauguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaaguccuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaggagagcucaucuaaggauuuugugugcuacaaggaagggacuggaccuuguucugaaucagaagaaaaggcuugcaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugaggcuaaucacucuaacuagugagcucaagucagcuacugucugugcuucccacuuuugcaguucugccacaagugguaagaaaagcacggagauucauuuccacucaggaucauugguugggaaagcagcuauccaugucaaaggggcauugguagaugggacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauagaggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagagcgcuucuuccugcggugaacccaggacaagaggcgugucugcacuucacggcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcaggcaagauggacagggcuggucuuggauucaguggcugcucugauggauguggaggagcagccugcggaugcuuuaaugcggccccuucaugcaucuucuggaggaaauggguggagaauccacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauugagucucucagaaauuacugccacuugcacaggggaggugacaaaugugaguggguguuauucuugcaugacaggcgccaaagucuccaucaaauugcauagcagcaaaaauagcacugcccauguuagauguaaaggggaugagacugcauucagugucuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacagcacugugcccacaggggcaaauaucccaagcccuacagauuggcugaaugccuuguuuggcaaugggcugaguagguggauccuaggggugauagggguucuacuggggggauuggcucucuuuuucuugaucauguuuuuguucaagcugggaacaaaacagguguuucgaucgaggacgaagcuggcuuag

SEQ ID NO: 4823 - RNA, 3222 nt, Artificial Sequence
  derived and/or modified CDS sequence (wt) from SFTSV(HB29)__KP202164.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccaccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauaacacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4824 - RNA, 3222 nt, Artificial Sequence
  derived and/or modified CDS sequence (wt) from SFTSV(HNXY_115)__KC292312.1__GP
augaugaaagucaucugguucuccucucugaucuacuuugucauucaaugcaguggggacucaggcucaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacguucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucugggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugagcauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacagagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggaucuugggggugauagggguucuacuugggggguuggcucucuuuuucaugauuaugucuuuguucaagcugggaacaaaacagguauuucgaucaaggacgaagcuggcuuag

SEQ ID NO: 4825 - RNA, 3222 nt, Artificial Sequence
  derived and/or modified CDS sequence (wt) from SFTSV(HNXY_144)__KC292307.1__GP
augaugaaagucaucugguucuccucucugaucugcuuugucauucaaugcaguggggacucgggcccaaucaucugcgcaggaccuauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuucuuugagcgaccaacuuuugauggauaugugggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucagauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccacuggacaucacagcuauaagaggaucuuuuucuguuaauuauagaggccuucgacugagccucucagaaauuacugcuaccugcacaggggaggugacaaaugugaguggauguuauucuugcaugacaggcgcaaaagucucuaucaaauugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggguuggcucucuuuuucaugaucaugucuuuguucaagcugggaacaaaacagguauuucgaucaaggacaaagcuggcuuag

SEQ ID NO: 4826 - RNA, 3222 nt, Artificial Sequence
  derived and/or modified CDS sequence (wt) from SFTSV(HNXY_157)__KC292305.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucuuagaauuaagguuaagaggaucaaccuaaaauguaagaagucaucaucauauuuuguuccugaugcccggucuagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4827 - RNA, 3222 nt, Artificial Sequence
  derived and/or modified CDS sequence (wt) from SFTSV(HNXY_170)__KC292304.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucuuagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaauaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauagggguucugcuugggggauuggcucucuuuuucaugaucaugucuuuguucaagcugggaacaaaacagguauuucgaucaaggacaaagcuggcuuag

SEQ ID NO: 4828 - RNA, 3222 nt, Artificial Sequence
  derived and/or modified CDS sequence (wt) from SFTSV(HNXY_174)__KC292306.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcagaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgagcggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagaguuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacguaucauagcacugugcccacaggggcaaacaucccaagcccaacagacuggcugaaugccuuguuuggcaaugggaugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4829 - RNA, 3222 nt, Artificial Sequence
  derived and/or modified CDS sequence (wt) from SFTSV(HNXY_182)__KC292324.1__GP
augaugaaagucaucugguucuccucucugaucugcuuugucauucaaugcaguggggacucaggcccaaucaucugcgcaggacccauccacucaaacaagagugcugacauaccucaccugcaggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaaggaacugggccuuguucugaaucagaagaaaagacuuguaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucuuugguugggaaaacagcaauacacgucaaaggggcauugguagauggaacugaauucacauuugaggguaguugcauguucccagaugguugugaugcaguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugaugucaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaaaaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguggagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacugaccuaugugagauagaggagcucaaguccaagaagcuggcauuagcucccugcaaccaggcuggcauggggguuguaggcaagguuggagagauucagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaagugacaaauguaaguggauguuauucuugcaugacaggcgccaaagucucuauuaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggguugauagggguucugcuugggggguuggcucucuuuuucaugauuaugucuuuguucaagcugggaacaaaacagguauuucgaucaaggacgaagcuggcuuag

SEQ ID NO: 4830 - RNA, 3222 nt, Artificial Sequence
  derived and/or modified CDS sequence (wt) from SFTSV(HNXY_188)__KC292301.1__GP
augaugaaagucaucugguucuccucucugaucugcuuagucauucaaugcgguggggguacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgaggcggacgcucucaggugagcuacuacccagccgaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucccacuuuugcaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaaaguuaagaggaucaaccuaaaauguaaaaagucaucaucauauuuuguuccugaugcccgguccagauguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuaguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4831 - RNA, 3222 nt, Artificial Sequence
  derived and/or modified CDS sequence (wt) from SFTSV(HNXY_191)__KC292323.1__GP
augaugaaagucaucugguucuccucucugaucugcuuagucauucaaugcgguggggauacgggcccaaucaucugcgcaggacccacccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuggaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugccacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucaaggacaaagcuggcuuag

SEQ ID NO: 4832 - RNA, 3222 nt, Artificial Sequence
  derived and/or modified CDS sequence (wt) from SFTSV(HNXY_195)__KC292326.1__GP
augaugaaagucaucugguucuccucucugaucugcuuugucauucaaugcaguggggacucaggcccaaucaucugcgcaggacccauccacucaaacaagagugcugacauaccucaccugcaggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugccucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4833 - RNA, 3222 nt, Artificial Sequence
  derived and/or modified CDS sequence (wt) from SFTSV(HNXY_2)__KC292318.1__GP
augaugaaagucaucugguucuccucucugaucugcuuugucauucaaugcaguggggacucaggcccaaucaucugcgcaggacccauccacucaaacaagagugcugacauaccucaccugcuggguuauucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucucaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaucccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagcgcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagccucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggaugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4834 - RNA, 3222 nt, Artificial Sequence
  derived and/or modified CDS sequence (wt) from SFTSV(HNXY_202)__KC292325.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaagaucaaccuaaaauguaagaggucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4835 - RNA, 3222 nt, Artificial Sequence
  derived and/or modified CDS sequence (wt) from SFTSV(HNXY_206)__KC292302.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgaggcggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucggggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccuacaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggaaaauagagagggcaaccaagaugauauuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaauguguuacaacugggagggcgcuucuuccugcggugaacccagggcaagaggcgugucugcacuucacgacaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguauccccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuaguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugccacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccuagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4836 - RNA, 3222 nt, Artificial Sequence
  derived and/or modified CDS sequence (wt) from SFTSV(HNXY_207)__KC292315.1__GP
augaugaaagucaucugguuccccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugagacuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguucauagcuacacugucagucucaguuuugaccaugcaguggucgaugagcagugccagcugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4837 - RNA, 3222 nt, Artificial Sequence
  derived and/or modified CDS sequence (wt) from SFTSV(HNXY_224)__KC292317.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagaccugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuguugucauccuccuuggguaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugaugucaggauugagauggcaagacccagaaggguaaggcauuggauguacucaccugucauccugacuauuuuagcaauagggcuuacugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugcgagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaacccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguaggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaagauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauaggaguucuacuugggggguuggcucucuuuuucaugauuaugucuuuguucaagcugggaacaaaacagguauuucgaucaaggacgaagcuggcuuag

SEQ ID NO: 4838 - RNA, 3222 nt, Artificial Sequence
  derived and/or modified CDS sequence (wt) from SFTSV(HNXY_231)__KC292313.1__GP
augaugaaagucaucugguucuccucucugaucugcuuugucauucaaugcaguggggacucaggcccaaucaucugcgcaggacccauccacucaaacaagagugcuggcauaccucaccugcuggguuacucugagaagauaugucagauagaucggcugauacauguuucgucauggcucaggaaccacucacaauuucagggcuacguaggccagcgagguggacgcucucaggugagcuacuacccagcugagaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugacugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcugguauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccacagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4839 - RNA, 3222 nt, Artificial Sequence
  derived and/or modified CDS sequence (wt) from SFTSV(HNXY_245)__KC292320.1__GP
augaugaaagucaucugguucuccucucugaucugcuuugucauucaaugcaguggggacucgggcccaaucaucugcgcaggacccauccacucaaacaagagcgcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaguguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacuaucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4840 - RNA, 3222 nt, Artificial Sequence
  derived and/or modified CDS sequence (wt) from SFTSV(HNXY_262)__KC292309.1__GP
augaugaaagucaucugguucuccucucugaucugcuuugucauucaaugcagcggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucgggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaaguccaggacagagucaggagagcucugcaguucagacucagggacuagcucuggucuucugcccucagauaggguucucuggauaggugauguugcuugucagcccaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggagggugaggcauuggauguacucaccugucauccugacuauuuuggcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagaguuaacaaugcccucaggggaggugaggacauuccaccccaugaguggcauccccacacaagucuucaagggugugagugugacuuacuugggcucagauauggaggugucuggcuugacugaccuaugugagauagaggagcucagguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauaguacugcccauguaagaugcaaaggggaugagacugcauucagugucuuggagggaguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucggucaaggacaaagcuggcuuag

SEQ ID NO: 4841 - RNA, 3222 nt, Artificial Sequence
  derived and/or modified CDS sequence (wt) from SFTSV(HNXY_278)__KC292322.1__GP
augaugaaagucaucugguucuccucucugaucugcuuagucauucaaugcgguggggauacgggcccaaucaucugcgcaggacccacccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcauaagaccaaauggguacaagagagcucauccaaggauuuugugugcuauaaggaagggacugggccguguucugaaucagaagaaaagacuugcaagaccgguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugagggcaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugaugucaggauugagauggccagaccuaggaggguaaggcauuggauguacucgccugucauccugacuauucuagcaauagggcuugcugagggcugugaugagaugauccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacacccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacuccaagaucacuaguguggaggcaguugcaaacuacuccgccauacccaccacuauuggggggcugagguuugagagaagccaugacagccaggguaaaauaucugguagcccccuggacaucacagcuauuagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacuaaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauugggguccuacuggggggauuggcucucuuuuucuugaucaugucuuuguuuaagcugggaacaaaacagauauuucgaucgaggacaaagcuggcuuag

SEQ ID NO: 4842 - RNA, 3222 nt, Artificial Sequence
  derived and/or modified CDS sequence (wt) from SFTSV(HNXY_31)__KC292310.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccugcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugcugcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagucucucagaaaucacugccacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauagcacugugcccacaggggcaaauaucccaagcccaacagacuggcugaaugccuuguuuggcaaugggcugaguagguggauccugggggugauagggguucuacuuggggggcuggcucucuuuuucaugauuaugucuuuguucaagcugggaacaaaacagguauuucgaucaaggacgaagcuggcuuag

SEQ ID NO: 4843 - RNA, 3222 nt, Artificial Sequence
  derived and/or modified CDS sequence (wt) from SFTSV/FTLSV(2011YGS5)__KF711925.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugaaggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccugcggugaauccaggacaagaggcgugucugcacuucacggcaccugggaguccggacucaaaaugucucaaaauuaaggucaagaggaucaaccuaaaauguaagaagucaucaucauauuuuguuccugaugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggggccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4844 - RNA, 3222 nt, Artificial Sequence
  derived and/or modified CDS sequence (wt) from SFTSV/FTLSV(2011YGS7)__KF711922.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucuaccagugugagggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaaccuaaaauguaagaagucaucaucauauuuuguuccugaugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4845 - RNA, 3222 nt, Artificial Sequence
  derived and/or modified CDS sequence (wt) from SFTSV/FTLSV(2011YPQ11)__KF711926.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaaccuaaaauguaagaagucaucaucauauuuuguuccugaugcccgguacagguguacaucagugaggagauguccaugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggaugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4846 - RNA, 3222 nt, Artificial Sequence
  derived and/or modified CDS sequence (wt) from SFTSV/FTLSV(2011YPQ12)__KF711930.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuggcaauagggcuugcugagggcugugaugagaugguccaugcugauucuaaacuuguuucgugcaggcaggggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccuguugcccgguacagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4847 - RNA, 3222 nt, Artificial Sequence
  derived and/or modified CDS sequence (wt) from SFTSV/FTLSV(2011YPQ17)__KF711923.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcauuggacugcacauucugucgugaguuucuaaaaaauccucauugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcauuucacggcaccugggaguccggacucaaaaugucucaaaauuaaggucaagaggaucaaccuaaaauguaagaagucaucaucauauuuuguuccugaugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4848 - RNA, 3222 nt, Artificial Sequence
  derived and/or modified CDS sequence (wt) from SFTSV/FTLSV(2011YSC22)__KF711927.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugaaggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaacguaaaauguaagaagucaucaucauauuuuguuccugaugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguugggcaaugggaugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4849 - RNA, 3222 nt, Artificial Sequence
  derived and/or modified CDS sequence (wt) from SFTSV/FTLSV(2011YSC60)__KF711945.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggaguacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccggaacagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacgauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaaguccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuaa

SEQ ID NO: 4850 - RNA, 3222 nt, Artificial Sequence
  derived and/or modified CDS sequence (wt) from SFTSV/FTLSV(2011YSH45)__KF711947.1__GP
augaugaaagucaucugguucuccucucugaucugcuuugucauucaaugcaguggggacucgggcccaaucaucugcgcaggaccuauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggcccucauacaaggggaaagucuuuuuugagcgaccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauacugacuauuuuagcaauagggcuugcugagagcugugaugagaugguccaugcugauuccaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuagaauguaagaagucaucaucauauuuuguuccugaugcccggaacagauguacaucagugaggagaugucguugggcuggagacugccagucugggugccccccucauuucacaucuaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugcgagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcagaaauagcacugcccauguaagaugcaaaggggaugagacugcauucaguguuuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4851 - RNA, 3222 nt, Artificial Sequence
  derived and/or modified CDS sequence (wt) from SFTSV/FTLSV(2011YSH52)__KF711928.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcauaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggcuucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaacaaaaaauguaaaaagucaucaucauauuuuguuccugaugcccgguacagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugucugaucugugugagauagaagagcucaacucaaagaagcucgcauuagcucccugcaaccaggcugguaugggggucguaggcaagguuggagagauacagugcaguagcgaggaaagugcccguaccauaaaaaaagaugggugcauaaggaaugcugaccucguggguauagagguacgcguggaugacgcuguguucuacuuuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucuugucuuuguuuaagcugggaacaaaacagauauuucgaucgaggacaaagcuggcuuag

SEQ ID NO: 4852 - RNA, 3222 nt, Artificial Sequence
  derived and/or modified CDS sequence (wt) from SFTSV/FTLSV(2011YXX9)__KF711924.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugggagggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaaccuaaaauguaagaagucaucaucauauuuuguuccugaugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4853 - RNA, 3222 nt, Artificial Sequence
  derived and/or modified CDS sequence (wt) from SFTSV/FTLSV(2012YGS10)__KF711937.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuguuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4854 - RNA, 3222 nt, Artificial Sequence
  derived and/or modified CDS sequence (wt) from SFTSV/FTLSV(2012YGS4)__KF711933.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugguugccccccucauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauacccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaagguaaaauaucugguaucccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4855 - RNA, 3222 nt, Artificial Sequence
  derived and/or modified CDS sequence (wt) from SFTSV/FTLSV(2012YSC6)__KF711931.1__GP
augaugaaagucaucugguucuccucucugaucugcuuugucauucaaugcagugggggcucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccauugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaacagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauacccacacaagucuucaagggugugagugugacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgauugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccuagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4856 - RNA, 3222 nt, Artificial Sequence
  derived and/or modified CDS sequence (wt) from SFTSV/FTLSV(2012YSH10)__KF711940.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccaugaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaaguccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4857 - RNA, 3222 nt, Artificial Sequence
  derived and/or modified CDS sequence (wt) from SFTSV/FTLSV(2012YSH104)__KF711943.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucguaaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaacgagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguacagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaagcugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4858 - RNA, 3222 nt, Artificial Sequence
  derived and/or modified CDS sequence (wt) from SFTSV/FTLSV(2012YSH105)__KF711944.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguagcugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucuggugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuagcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4859 - RNA, 3222 nt, Artificial Sequence
  derived and/or modified CDS sequence (wt) from SFTSV/FTLSV(2012YSH107)__KF711942.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaagaagggacugggccuuguucugaaucagaagaaaagacuggcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacgacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguacagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuagcucucuuuuucaugaucaugucuuuguucaagcugggaacaaaacagguauuucgaucaaggacaaagcuggcuuag

SEQ ID NO: 4860 - RNA, 3222 nt, Artificial Sequence
  derived and/or modified CDS sequence (wt) from SFTSV/FTLSV(2012YSH14)__KF711938.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauuguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaauugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaagucaaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagauuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4861 - RNA, 3222 nt, Artificial Sequence
  derived and/or modified CDS sequence (wt) from SFTSV/FTLSV(2012YSH16)__KF711934.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucucaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguacagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4862 - RNA, 3222 nt, Artificial Sequence
  derived and/or modified CDS sequence (wt) from SFTSV/FTLSV(2012YSH6)__KF711921.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugaaaauucuuacucgagguggaauggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguagcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauuaguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuagucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccugaugcccgguccagauguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaguugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4863 - RNA, 3222 nt, Artificial Sequence
  derived and/or modified CDS sequence (wt) from SFTSV/FTLSV(2012YSH86)__KF711939.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugccaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaaggcaagugauccaugaggagauaggggagaauagagagggcaaccaagaugaugucaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuacgaucaaggacgaagcuggcuuag

SEQ ID NO: 4864 - RNA, 3222 nt, Artificial Sequence
  derived and/or modified CDS sequence (wt) from SFTSV/FTLSV(2012YSH89)__KF711935.1__GP
augaugaaagucaucugguucuccucucugaucugcuuugucauucaaugcaguggggacucaggcccaaucaucugcgcaggacccauccacucaaacaagagugcugacauaccucaccugcuggguuauucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucucaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaucccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagcgcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugaggcugcauucagugucuuggaggggguccauagcuacacugucagccucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4865 - RNA, 3222 nt, Artificial Sequence
  derived and/or modified CDS sequence (wt) from SFTSV/FTLSV(2012YSH9)__KF711919.1__GP
augaugaaagucaucugguucuccucucugaucugcuuagucauucaaugcaguggggacucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucggguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaaccguccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaaacacggagauucauuuccacucaggaucauugguugggaaaacagcuauccaugucaaaggggcauugguagaugggacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugaugucaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggaugugguggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4866 - RNA, 3222 nt, Artificial Sequence
  derived and/or modified CDS sequence (wt) from SFTSV/FTLSV(2012YSH91)__KF711920.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccauccaugaggagacauuucuggagcugaagaguuuuagccaaagugaauucccagacauauguaagauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagagaaggcaucugagaccaaguguagaugcucacuugugcacaagccuggggaagucguugugucauauggagggaugcgugucagaccaaagugcuacgguaucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaacauaaaauguaagaagucaucaucauauuuuguucgugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagaaacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4867 - RNA, 3222 nt, Artificial Sequence
  derived and/or modified CDS sequence (wt) from SFTSV/FTLSV(2012YSH92)__KF711941.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucucacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucacaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccucagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacgacugggagggcgcuucuuccugcggugaacccaggucaagaggcaugucugcacuucacggcaccugggaguccggacucaaaaugucucagaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugaugcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaaguaacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4868 - RNA, 3222 nt, Artificial Sequence
  derived and/or modified CDS sequence (wt) from SFTSV/FTLSV(2012YSH93)__KF711946.1__GP
augaugaaagucaucugguucuccucucugaucugcuuugucauucaaugcaguggggacucgggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucaaauaggguucucuggauaggugauguugcuugucagccuaugacacccaucccugaggagacauuucuggagcugaagaguuucagccaaagugaauucccagacauaugcaaaauugauggcauuguauucaaccagugugagggugagagccuaccccagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaacgagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguacagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggguccugggggugauggggguucugcuugggggauuggcucucuuuuucaugaucaugucuuuguucaagcugggaacaaaacagguauuucgaucaaggacaaagcuggcuuag

SEQ ID NO: 4869 - RNA, 3222 nt, Artificial Sequence
  derived and/or modified CDS sequence (wt) from SFTSV/FTLSV(YGS1)__KF356537.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaagagagcucaucuaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggagguaucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4870 - RNA, 3222 nt, Artificial Sequence
  derived and/or modified CDS sequence (wt) from SFTSV/FTLSV(YNY1)__KF356538.1__GP
augaugaaagucaucugguucuccucucugaucugcuuugucauucaaugcaguggggacucgggcccaaucaucugcgcaggaccuauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcgaccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguauucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaggccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcaccuucugucgugaguuucuaaaaaauccccagugcuacccugcaaagaaguggcuguucaucauuauugucauccucuuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcuugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggccggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagccccuuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugcuuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4871 - RNA, 3222 nt, Artificial Sequence
  derived and/or modified CDS sequence (wt) from SFTSV/FTLSV(YPQ133)__KF356530.1__GP
augaugaaagucaucugguucuccucucugaucugcuuugucauucaaugcaguggggacucgagcccaaucaucugcgcaggacccauccacucaaacaagagugcugacauaccucaccugcuggguuacucugaaaagauaugucagauagaucggcugauacauguuucgucauggcucagaaaccacucacaauuucagggcuacguugggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagaguuuaccucagcccuuugauguugcauggauggauguuggccacucucaaaaaaucaucaugagagagcacaagaccaaaugggugcaagagagcucauccaaggacuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaagaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaagacaagugauccaugaggagauaggggagaauagagagggcaaccaagaugauguuaggauugagauggcaagacccaggaggguaaggcauuggauguacucaccugucauccugaccauuuuagcaauagggcuugcugagagcugugaugagaugguccaugcugauucuaagcuuguuucaugcaggcaagggagcggaaauaugaaggaaugugucacaacugggagggcgcuucuuccugcagugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcaggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacauggggucaucuggaaaguaucuccuugugccgcaugggucccuucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcggaccuugugggcauagagcuacgaguggaugacgcugugugcuacucuaagaucacuaguguggaagcaguugcaaacuacucugccauacccaccacuauuggggggcugagauuugagagaagccaugacagccaggguaaaauaucugguagcccccuggacaucacagcuauaagaggaucuuuuucuguuaauuauagaggccuucgacugagccucucagaaauuacugcaaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucuuaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4872 - RNA, 3222 nt, Artificial Sequence
  derived and/or modified CDS sequence (wt) from SFTSV/FTLSV(YPQ2)__KF356531.1__GP
augaugaaagucaucugguucuccucucugaucugcuuugucauucaaugcaguggggacucgggcccaaucaucugcgcaggaccuauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcgaccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucugccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaauagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggagaguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccuauggcccgguucagauguacaucagugaggagaugucguugggcuggagacugccagucugggugccccccucauuucacauccaacuccuuuucugaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccagguuaaaauaucugguagcccccuggacaucacagcuaugagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuucuuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucgaucaaggacaaagcuggcuuag

SEQ ID NO: 4873 - RNA, 3222 nt, Artificial Sequence
  derived and/or modified CDS sequence (wt) from SFTSV/FTLSV(YPQ5)__KF356532.1__GP
augaugaaagucaucugguucuccucucugaucugcuuugucauucaaugcaguggggacucgggcccaaucaucugcgcaggacccauccacucaaacaaaagugcugacauaccucaccugcuggguuacucugagaagauaugucagauagaucggcugauacauguuucgucauggcucagaaaccacucacaauuucagggcuacguagggcagcgagguggacgcucucgggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcagugggaaguccaggacagagucaggagagcucugcaguucagacucagggacuagcucuggucuucugcccucagauaggguucucuggauaggugauguugcuugucagcccaugacacccaucccugaggagacauuucuggagcugaagaguuuuagccaaagugaauucccagacauaugcaaaauugauggcauuguguucaaccagugugagggugagaguuuaccucagcccuuugauguugcauggauggauguuggccacucucacaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucccacuuuuguaguucugccacgaguggcaagaagagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccaggagggugaggcauuggauguacucaccugucauccugacuauuuuggcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccuguugcccgguacagauguacaucagugaggagaugucguugggcuggagacugccagucugggugccccccucauuucacauccaacuccuuuucuaaugauugggcagguaagauggacagggcuggucuaggguucagugguugcucugauggauguggaggagcagccugcggcugcuuuaaugcagccccuucaugcaucuucuggaggaaauggguagagaauccacaugggaucaucuggaaaguaucuccuugugccgcaugggucccaucggcagucauagaguuaacaaugcccucaggggaggugaggacauuccaccccaugaguggcauccccacacaagucuucaagggugugagugugacuuacuugggcucauauauggagguaucuggcuugacugaccuaugugagauagaggagcucagguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauaguacugcccauguaagaugcaaaggggaugagacugcauucagugucuuggagggaguccauagcuacacugucagucucaguuuugaccaugcaguagucgaugagcagugccaacugaacugugggggacaugagagucaagugacucuaaaaggcaaccuuaucuuucuggaugucccaaaauuuguggauggcagcuacaugcagacauaucauagcacugugcccacaggggcaaacaucccaagcccaacagacuggcugaaugccuuguuuggcaaugggcugaguagguggauccugggggugauggggguucugcuugggggauuggcucucuuuuucaugaucaugucuuuguucaagcugggaacaaaacagguauuucggucaaggacaaagcuggcuuag

SEQ ID NO: 4874 - RNA, 3222 nt, Artificial Sequence
  derived and/or modified CDS sequence (wt) from SFTSV/FTLSV(YSC19)__KF356536.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuacaaggaagggacuggaccuuguucugaaucagaagaaaaggcuuguaagaccaguggaucaugcaggggggacaugcaguuuugcaagguggcagguugugaacauggggaggaggcaucugaagccaaguguagaugcucacuugugcacaagccuggggaagucguugugucauauggagggaugcgugucagaccaaagugcuaugguuucuccagaaugauggcaacaauggaggugaacccaccagagcaaaggauuggucaaugcacuggcugccaucuagaaugcauaaaugggggugugagacuaaucacucuaaccagugagcucaagucagcuacugucugugcuucccacuucugcaguucugccacaagugguaagaaaagcacggagauucauuuccacucaggaucauugguugggaaaacagcuauccaugucaaaggggcauugguagauggaacugaauucacauuugaggguaguugcauguucccagauggauguaaugcaguggacugcacauucugucgugaguuucuaaaaaauccucagugcuacccugcaaagaaguggcuguucaucauuauugucauccuccuuggauaugcaggccucaugcuacucaccaauguccuuaaggcaauuggggucugggggucaugggugauagcuccagugaagcuaauguuugccaucaugaagaaacuaaugagaacugugagcugcuugguggggaaauugauggauaggggaaggcaagugauccaugaggaaauaggggagaauggggagggcaaccaugaugauguuaggauugagauggcaagacccagaaggguaaggcauuggauguacucaccugucauccugaccauucuagcaauagggcuugcugagggcugugaugagaugguccaugcugauucuaaacuuguuucaugcaggcaagggagcggaaauaugaaggaaugcgucacaacugggagggcgcuucuuccuucggugaauccaggacaagaggcgugucugcacuucacggcaccugggaguccggacucaaaaugucucaaaauuaaggucaagaggaucaaccuaaaauguaagaagucaucaucauauuuuguuccuauugcccggaacagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggaugcuuuaaugcggccccuucaugcaucuucuggaggaaauggguggagaauucacaugggaucaucuggaaaguaucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaagaagcuggcauuagcucccugcaaccaggcuggcauggggguuguaggcaagguuggagagauacagugcaguagcgaggagagugcccguaccauaaaaaaagauggguguauauggaaugcagaccucgugggaauagagcuacgaguggaugacgcugugugcuacucuaagauuacuaguguggaggcaguugcaaacuacucugccauaccuaccacuauuggggggcugagguuugagagaagccaugacagccaggguaaaauaucugguagcccccuggacaucacagcuauaagaggauccuuuucuguaaauuauagaggccuucgauuaagucucucagaaauuacugcuacuugcacaggggaggugacaaaugugaguggguguuauucuugcaugacaggcgccaaagucuccaucaaauugcauagcagcaaaaauagcacugcccauguuagaugcaaaggggaugagacugcauucaguguuuuggagggaguccauagcuacacugucagccucagcuuugaccaugcaguagucgaugagcagugccaacugaacugugggggacaugagagucaagugacucuaaagggcaaccucaucuuccuggaugucccaaaauuuguggauggcagcuacaugcagacauaucacaguacugugcccacaggggcaaacaucccaagcccuacagauuggcugaaugccuuguuuggcaaugggcugaguagguggauccugggggugauagggguucuacuggggggauuggcucucuuuuucuugaucauguuuuuguucaagcugggaacaaaacagguguuucgaucgaggacgaagcuggcuuag

SEQ ID NO: 4875 - RNA, 3222 nt, Artificial Sequence
  derived and/or modified CDS sequence (wt) from SFTSV/FTLSV(YSC3)__KF356535.1__GP
augaugaaagucaucugguucuccucucuggucugcuuagucauucaaugcaguggggauucgggcccaaucaucugcgcaggacccauccacucaaacaagagugcugccauaccccaccugcuugguuacucugagaagauuugucagauagaucggcugauacauguuucgucauggcucaggaaccacucgcaauuucaaggcuacguagggcagcgagguggacgcucucaggugagcuacuacccagcugagaauucuuacucgagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcuguggcagugggaagucuaggacagagucaggagagcucugcaguucagacucagggacuaguucuggucuacugcccucggauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggauaaggcauuggauguacucgccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccggucuagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagcuaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguucggcaauggacugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4876 - RNA, 3222 nt, Artificial Sequence
  derived and/or modified CDS sequence (wt) from SFTSV/FTLSV(YSH39)__KF356529.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuuggaaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugccaucagauaggguucucuggauaggugauguugcuugucagccuaugacacccaucccugaagagacauuuauggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcguaucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucugaaaaauccccagugcuacccugcaaagaaguggcuguucaucauuauugucauccuccuugggcaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccuaacuauuuuagcaauagggcuugcugagagcugugaugagaugguccaugcugauucuaagcuuguuucaugcaggcaagggagcggaaauaugaaggaauguguaacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguaguccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguucauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4877 - RNA, 3222 nt, Artificial Sequence
  derived and/or modified CDS sequence (wt) from SFTSV/FTLSV(YSHX002)__KF356540.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugaaaauucuuacucgagguggaauggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguagcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauuaguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuagucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagaaacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaguugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4878 - RNA, 3222 nt, Artificial Sequence
  derived and/or modified CDS sequence (wt) from SFTSV/FTLSV(YXX2)__KF356534.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgaggcggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucggggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggaaaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaauguguuacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguauccccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuaguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgauugagucucucagaaaucacugccacuugcacaggggaagugacaaaugugaguggguguuauucuugcaugacaggcgccaaagucuccaucaaguugcauagcagcaaaaauagcacugcccauguaagaugcaaaggggaugagacugccuuuagugucuuggagggaguccauagcuacucugucagucucaguuuugauuaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccuagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4879 - RNA, 3222 nt, Artificial Sequence
  derived and/or modified CDS sequence (wt) from SFTSV/Huaiyangshan virus(2010-FQM)__HQ419236.1__GP
augaugaaagucaucugguucuccucucugaucugcuuagucauucaaugcgguggggacacgggcccaaucauuugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaaggcuugcaaggccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcugaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccuuaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuucgaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucauguuuuuguuuaagcugggaacaaaacagauauuucgaucgaggacaaagcuggcuuag

SEQ ID NO: 4880 - RNA, 3222 nt, Artificial Sequence
  derived and/or modified CDS sequence (wt) from SFTSV/Huaiyangshan virus(2010-LZR)__HQ419237.1__GP
augaugaaagucaucugguucuccucucugaucugcuuagucauucaaugcgguggggauacgggcccaaucaucugcgcaggacccauccacucaaacaagagugcugacauaccccaccugcuuggcuacucugagaagauuugucagauagaucggcugauacauguuucgucuuggcuuagaaaccacucacaauuucagggcuacguagggcagcgaggcggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauuuugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcauggaucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccuaguggguauagagcuacggguggaugacgcugugugcuacucuaagaucacaaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4881 - RNA, 3222 nt, Artificial Sequence
  derived and/or modified CDS sequence (wt) from SFTSV/Huaiyangshan virus(2010-T112)__HQ419238.1__GP
augaugaaagucaucugguucuccucucugaucugcuuugucauucaaugcaguggggacucgggcccaaucaucugcgcaggacccauccauucaaacaagagugcugacauaccucaccugcugggcuacucugagaagauaugucagauagaucggcugauacauguuucgucauggcucagaaaccacucacaauuucagggcuacguagggcagcgaggaggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcuggggcuguggcaguggaaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguucacaagcccggagaagucguugugucauauggagggaugcgugucagaccaaagugcuaugguuucuccagaaugauggcaacacuggaggugaaccaaccagugcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauacaauuccacucaggaucauugguugggaaaacagcaauacacgucaaaggggcauugguagauggaacugaauucacauuugaggguagcugcauguucccggaugguugugaugcgguggacugcacuuucugucgugaguuucuaaaaaauccucagugcuacccugcaaagaaguggcuguucaucaucauugucauccuccuuggauaugcaggccucaugcuacucaccaauguccucaaggcaauuggaauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacgcaccugucauccugacuauuuuagcaauggggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaaugcaagaagucaucaucauauuuuguuccugaugcccgguccagauguacaucagugaggagaugucguugggcuggagacugccagucagggugccccccucauuucacauccaacucuuuuucugaugauugggcaggcaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugucgcaugggucccaucggcagucauagagcuaacaaugcccucaggggaggugaggacauuccaccccaugaguggcaucccuacacaagucuucaagggugugagugugacuuacuugggcucagauauggaggugucuggcuugacugacuuaugugagauagaggagcucaaguccaagaagcuggcauuagcucccugcaaccaggcuggcauggggguuguaggcaagguuggagagauacagugcagcagcgaggaaagugcccguaccauaaaaaaagaugggugcauauggaaugcagaccuugugggcauagagcuacgaguggaugaugcugugugcuacucuaagaucacuaguguagaagcaguugcaaacuacucugccauacccaccacuauuggggggcugagguuugagagaagccaugacagccaggguaaaauaucugguagcccucuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaagcugcauaguagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacgaagcuggcuuag

SEQ ID NO: 4882 - RNA, 3222 nt, Artificial Sequence
  derived and/or modified CDS sequence (wt) from SFTSV/Huaiyangshan virus(2010-WJ)__HQ419229.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggcaagcgagguggacgcucucaggugagcuacuaccuagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugccuucggauaggguucucuggauaggugauguugcuugucagccuaugacaccaaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugcuucucacuuuuguaguucugccacaaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguucucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacacccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4883 - RNA, 3222 nt, Artificial Sequence
  derived and/or modified CDS sequence (wt) from SFTSV/Huaiyangshan virus(2010-WJQ)__HQ419230.1__GP
augaugaaagucaucugguucuccucucugaucugcuuagucauucaaugcgguggggauacgggcccaaucaucugcgcaggacccacccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucagauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucauuaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcuuugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccggguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcuggcauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauaagaggaucuuuuucugucaauuauagaggccuucgacugagucucucagaaaucacugcuacuugcacaggggaagugaccaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagauggauucugggggugauagggguccuacuggggggauuggcucucuuuuucuugaucaugucuuuguuuaagcugggaacaaaacagauauuucgaucgaggacaaagcuggcuuag

SEQ ID NO: 4884 - RNA, 3222 nt, Artificial Sequence
  derived and/or modified CDS sequence (wt) from SFTSV/Huaiyangshan virus(2010-WSQ)__HQ419235.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaagggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugauugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucaucauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugaggacugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaaccuaaaauguaagaagucaucaucauauuuuguuccugaugcccgguccagguguacgucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagaaaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4885 - RNA, 3222 nt, Artificial Sequence
  derived and/or modified CDS sequence (wt) from SFTSV/Huaiyangshan virus(2010-WWG)__HQ419231.1__GP
augaugaaagucaucugguucuccacucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugagcggccaacuuuugauggauauguaggcugggguuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucuguaagguagcagguugugaacauggggaagaggcaucugaagccaaguguagaugcucacuugugcacaagcccggagaagucguugugucauauggagggaugcgugucagaccaaagugcuaugguuuccccagaaugauggcaacacuggaggugaaccaaccugagcaaaggauuggucaaugcacuggcugccaucuggaaugcauaaaugggggugugaggcuaauaacucuaaccagugagcucaggucagcuacugucugugcuucccacuuuuguaguucugccacaaguggcaagaaaagcacggagauucaauuccacucaggaucauugguugggaaaacagcaauacacgucaaaggggcauugguagauggaacagaauucacauuugaggguaguugcauguucccagaugguugugaugcgguggacugcacuuucugucgugaguuucuaaaaaauccccagugcuacccugcaaagaaguggcugcucaucauuauugucauccuccuuggauaugcaggccucaugcuacucaccaauguccucaaggcaauugguauuuggggaucaugggucauagcuccagugaagcuaauauuugccaucauaaagaaacuaaugagagcugugagcugcuugauggggaaauugauggauaggggaaggcaggugauccaugaggggauaggggagaauagagagggcaaccaggaugauguuaggauugagauggcaagaccuagaaggguaaggcauuggauguacucaccugucauccugacuauuuuagcaauagggcuugcugagagcugugaugagaugguccaugcugauucuaagcuugucucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcugguuuaggguucaguggcugcucugauggguguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugaccuaugugagauagaggagcucaaguccaagaagcuggcauuggcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcauagcagcaaaaauagcacugcucauguaagaugcaaaggggaugagacugcauucagugucuuggaggggguccauagcuacacugucagucucaguuuugaucaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucugcuugggggguuggcucucuuuuuuaugauuaugucuuuguucaagcugggaacaaaacagguauuucgaucaaggacgaagcuggcuuag

SEQ ID NO: 4886 - RNA, 3222 nt, Artificial Sequence
  derived and/or modified CDS sequence (wt) from SFTSV/Huaiyangshan virus(2010-WWX)__HQ419232.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccuucuggaaugcauaaaugggggugugaggcuaauaacucuaaccagugagcucaagucagcuacugucugugcuucucacuuuuguaguucugccacgaguggcaagaaaagcacggagauucaauuccacucaggaucauugguugggaaaacagcaauacacgucaaaggggcauugauagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcagccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuugggcucagauauggaggugucuggcuugacugacuuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaauuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4887 - RNA, 3222 nt, Artificial Sequence
  derived and/or modified CDS sequence (wt) from SFTSV/Huaiyangshan virus(2010-ZGQ)__HQ419233.1__GP
augaugaaagucaucugguucuccucucugaucugcuuagucauucaaugcgguggggauacgggcccaaucaucugcgcaggacccacccacucaaacaagagugcugacauaccccaccugcuuggcuacucugagaagauuugucagauagaucggcugauacauguuucgucuuggcuuagaaaccacucacaauuucagggcuacguagggcagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacuccgggacuaguucuggucuucugcccucggauaggguucucuggauaggugauguugcuugucagccaaugacacccaucccugaggagacauuucuggagcugaagagcuuuagccaaagugaauucccagacauaugcaaaauugauggcauuguguucaaccagugugagggugagagucuaccccagcccuuugauguugcauggauggauguuggccacucucauaaaaucaucaugagggagcacaagaccaaauggguacaagagagcucauccaaggauuuugugugcuauaaggaagggacugggccguguucugaaucagaagaaaagacuugcaagaccaguggaucaugcaggggggacaugcaguuuugcaagguggcagguugugaacauggggaagaggcaucugaagccaaguguagaugcucacuugugcacaagccaggggaagucguugugucauauggagggaugcgugucagaccaaagugcuaugguuucuccagaaugauggcaacacuggaggugagccagccagagcaaaggauuggucaaugcacuggcugccaucuagaaugcauaaaugggggugugaggcuaaucacucuaaccagugagcucaagucagcuacugucugcgcuucucacuuuugcaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuguugucauccuccuuggauaugcaggccucaugcugcucaccaauguucuuaaggcaauugggguuugggggucaugggucauagcuccagugaagcuaguguuugccaucauaaagaaacugaugagagcugugagcugccugauggggaaauugauggauaggggaaggcaagugauccaugaggaaauaggggagaauagagagggcaaccaagaugaugucaggauugagauggccagacccaggaggguaaggcauuggauguacucgccugucauccugacuauucuagcaauagggcuugcugagggcugugaugagaugguccaugcugauucuaaacuuguuucgugcaggcaagggagcggaaauaugaaggaaugugucacaacugggagggcgcuucuuccugcggugaacccagggcaagaggcgugucugcacuucacggcaccuggaaguccagacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaucugugugagauagaagagcucaagucaaagaagcuugcauuagcucccugcaaccaggcugguauggggguuguaggcaagguuggagagauacagugcaguagcgaggaaagugcccguacaauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccaggguaaaauaucugguagcccccuggacaucacagcuauuagaggaucuuuuucugucaauuauagaggccuucgacugagucucucagaaaucacugcuacuugcacaggggaagugacaaaugugaguggguguuauucuugcaugacaggcgccaaagucuccaucaaguugcauagcagcaaaaauagcacugcccauguaaggugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguuuaagcugggaacaaaacagauauuucgaucgaggacaaagcuggcuuag

SEQ ID NO: 4888 - RNA, 3222 nt, Artificial Sequence
  derived and/or modified CDS sequence (wt) from SFTSV/Huaiyangshan virus(M-HZM)__JF951393.1__GP
augaugaaagucaucugguucuccucucugaccugcuuagucauucaaugcaguggggacucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccuccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaaacacggagauucauuuccacucaggaucauugguugggaaaacagcuauccaugucaaaggggcauugguagaugggacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccagggcaagaggcaugucugcacuucacagcaccugggaguccggacucaaaaugucucaaaauuaaggucaagaggaucaacuuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggaugugguggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuuaagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4889 - RNA, 3222 nt, Artificial Sequence
  derived and/or modified CDS sequence (wt) from SFTSV/Phlebovirus(AH15/China/2010 strain AH15)__HQ141593.1__GP
augaugaaagucaucugguucuucucucugaucugcuuagucauucaaugcgguggggauacaggcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgaucucaggugagcuacuacccagcugaaaauucuuacucaagguggaguggacuucuaagccccugugaugcugauuggcuugggaugcuugucgugaagaaggccaaggggucugauaugauaguuccagggccuucauacaaggggaaagucuuuuuugaacggccaacuuuugauggauacguaggcuggggcugugguagugggaagucuaggacugagucaggugagcucugcaguucagacuccgggacuaguucuggucuucugcccucagauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucagcccuuugauguugcauggauggguguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaagugcagaugcucacuugugcacaagcccggggaagucguugugucauauggagggaugcgugucagaccaaagugcuaugguuucuccagaaugauggcaacacuggaggugaacgaaccagagcagaggauuggucaaugcacuggcugccaucuagaaugcauaaaugggggugugaggcuaaucacucuaaccagugagcucaagucagcuacugucugcgcuucucacuucuguaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauagaggaaggcaagugauccaugaggaaauaggggagaauagagagggcaaccaagaugauguuaggauugagauggccagacccaggaggguaaggcauuggauguacucgccugucauccugacuauucuagcaauggggcuugcugagggcugugaugagaugguccaugcugauucuaaacuuguuucgugcaggcaagggagcggaaauaugaaggaaugugucacaacugggagggcgcuucuuccugcagugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugugguugcuuuaaugcggccccuucuugcauuuucuggaggaaauggguagagaauccacaugggaucaucuggaaaguaucuccaugugccgcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacucugccauacccaccacuauuggggggcugagguuugagagaagccaugacagccagggcaaaauaucugguagcccccuggacaucacagcuauaagaggaucuuuuucuaucaauuauagaggccuucgacugagccucacagaaauuacugcaacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauagcacugugcccacaggggcaaauaucccaagcccuacagauuggcuaaaugccuuguuuggcaaugggcugaguagguggauccugggggugauagggguccuacuggggggauuggcucucuuuuucuugaucaugucuuuguucaagcugggaacaaaacagguauuucgaucgaggacgaagcuggcuuaa

SEQ ID NO: 4890 - RNA, 3222 nt, Artificial Sequence
  derived and/or modified CDS sequence (wt) from SFTSV/Phlebovirus(HN6/China/2010 strain HN6)__HQ141596.1__GP
augaugaaagucaucugguucuccucucugaucugcuuugucauucaaugcaguggggacucaggcccaaucaucugcgcaggacccauccacucaaacaagagugcugacauaccucaccugcuggguuacucugagaagauaugucagauagaucggcugauacauguuucgucauggcucaggaaccacucacaauuucagggcuacguaggccagcgagguggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguauucaaccagugugagggugagagccuaccucagcccuuugauguugcauggauggauguuggccacucucauaaaaucaucaugagggagcacaagaccaaaugggugcaggagagcucauccaaggauuuugugugcuacaaggaagggacugggccuuguucugaaucagaagaaaagacuuguaagaccaguggaucaugcaggggggacaugcaguucugcaagguagcagguugugaacauggggaagaggcaucugaagccaagugcagaugcucacuugugcacaagcccggagaagucguugugucauauggagggaugcgugucagaccaaagugcuaugguuucuccagaaugauggcaacacuggaggugaaccaaccagagcaaaggauuggucaaugcacuggcugccaucuggaaugcauaaaugggggugugaggcuaauaacucuaaccagugagcucaagucagcuacugucugugccucucacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggguaugcaggccucaugcuacucaccaauguccucaaggcaauugggauuuggggaucaugggucauagcuccagugaagcuaauauuugccaucauaaagaaacuaaugagaacugugagcugcuugguggggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccucauuucacauccaacuccuuuucugaugauugggcagguaagauggacagggcuggucuaggguucaguggcugcucugauggauguggaggagcugccugcggcugcuuuaaugcagccccuucuugcaucuucuggaggaaauggguagagaacccacaugggaucaucuggaaaguaucuccuugugccgcaugggucccaucggcagucauagagcuaacaaugcccucaggggagaugaggacauuccaccccaugaguggcauccccacacaagucuucaagggugugagugugacuuacuugggcucagauauggaggugucuggcuugacugacuuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccacagucucuaucaaacuacauagcagcaaaaauagcacugcccauguaagaugcaaaggggaugagacugcauucagugucuuggaggggguccauagcuacacugucagucucaguuuugaccaugcaguggucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucuacuugggggguuggcucucuuuuucaugauuaugucuuuguucaagcugggaacaaaacagguauuucgaucaaggacgaagcuggcuuag

SEQ ID NO: 4891 - RNA, 3222 nt, Artificial Sequence
  derived and/or modified CDS sequence (wt) from SFTSV/Phlebovirus(JN1/China/2010)__JN258706.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccaaacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuagucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcacuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcucgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuagcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuugaagggaguccauagcuacauugucagccucagcuuugaccaugcaguagucgaugagcaaugccagcugaacugugggggacaugagagucaagugacucuuaaaggcaaccucaucuuccuggaugucccaauauuuguggauggcagcuacaugcagacauaucacaguacugugccaacaggggcaaauaucccaagcccuacagauuggcugaaugccuuguuuggcaaugggcugaguagguggauccugggggugauagggguucuacuggguggauuggcucucuuuuucuugaucauguuuuugcucaagcugggaacaaaacagguauuucgaucgaggacgaagcuggcuuag

SEQ ID NO: 4892 - RNA, 3222 nt, Artificial Sequence
  derived and/or modified CDS sequence (wt) from SFTSV/Phlebovirus(JS2010-014)__JQ317170.1__GP
augaugaaagucaucugguucuccuaucugaucugcuuugucauucaaugcaguggggacucgggcccaaucaucugggcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagagcuuuagccaaagugaauucccagacauaugcaaaauugauggcauuguguucaaccagugugagggugagagucuaccucagccuuuugauguugcauggauggauguuggccacucucauaaaauuaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguacacaagcccggagaagucguugugucauauggagggaugcguaucagaccaaagugcuaugguuucuccagaaugauggcaacacuggaggugagccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuugggggucaugggucauagcuccagugaagcuaauguuugccaucauaaagaaacuaaugagaacugugagcugcuugaugaggaaauugauggauagggggaggcaagugauccaugaggagauaggggagaauagagugggcaaccaagaugauguuaggauugagauggcaagacccagaaggguaaggcauuggauguacucaccugucauccuaacuauuuuagcaauagggcuugcugagagcugcgaugagaugguccaugcugauucuaagcuuguuucaugcaggcaagggagcggaaacaugaaggaaugugucacaacugggagggcgcuucuuccugcggugaacccaggucaagaggcaugucugcacuucacggcaccugggaguccggacucaaaaugccucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcggccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuagacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacuguggggggcaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuuuaugauuaugucuuuguucaagcugggaacaaaacagguauuucgaucaaggacaaagcuggcuuag

SEQ ID NO: 4893 - RNA, 3222 nt, Artificial Sequence
  derived and/or modified CDS sequence (wt) from SFTSV/Phlebovirus(JS2010-015)__JQ317173.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucuuacucaagguggagugggcuucuaagccccugugaugcugauuggcuugggaugcuuguugugaagaaggccaaggggucugacaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguuuaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguugcagguugugaacauggggaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggauuggccaaugcacuggcugccaucuagaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauccacgucaaaggggcauugguagauggaacugaauucacauuugaggguaguugcauguucccagaugguuguaaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaagacaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagguguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4894 - RNA, 3222 nt, Artificial Sequence
  derived and/or modified CDS sequence (wt) from SFTSV/Phlebovirus(JS2010-019)__JQ317179.1__GP
augaugaaagucaucugguucuccucucugaccugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucagguuagcuacuacccagcugaaaauucuuacucaagguggagugggcuucuaagccccugugaugcugauuggcuugggaugcuuguugugaagaaggccaaggggucugauaugauaguuccugggccuucauacaaggggaaagucuuuuuugagcggccaacuuuugauggauauguaggcuggggcugugguagugggaagucuaggacagagucaggggagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguucaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguagcagguugugaacauggagaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggcuuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguugugaugcgguggacugcacuuucugucgugaguuucuaaaaaauccccagugcuacccugcaaagaaguggcuauucaucauuauuguaauccuccuuggauaugcaggccucaugcuacucaccaauguccucaaggcaauugggauuuggggaucaugggucauagcuccagugaagcuaauguuugccaucauaaagaaacuaaugagaacugugagcugcuugaugaggaaauugauggauaggggaaggcaagugauccaugaggagauaggggagaauagagagggcaaccaagaugauguuaggauugagauggcaagacccagaaggguaaggcauuggauguacucaccugucauccugacuauuuuagcaauagggcuugcugagagcugcgaugagaugguccaugcugauucuaagcuuguuucaugcaggcaagggagcggaaauaugaaggaaugugucacaacugggagggcgcuucuuucugcggugaacccaggucaagaggcaugucugcacuucacggcaccugggaguccggacucaaaaugucucaaaauuaagguuaagaggaucaaccuaaaauguaagaagucaucaucauauuuuguuccugaugcccgguccagauguacaucagugaggagaugucguugggcuggagacugccagucugggugccccccccauuucacauccaacuccuuuucugaugauugggcagguaagauggacagggcuggucuaggguuuaguggcugcucugauggauguggaggagcagccugcggcugcuuuaaugcagccccuucaugcaucuucuggaggaaauggguagagaacccacauggaaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaaacuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcuguguguuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacugcauucagugucuuggagggaggucauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4895 - RNA, 3222 nt, Artificial Sequence
  derived and/or modified CDS sequence (wt) from SFTSV/Phlebovirus(JS24)__HQ830164.1__GP
augaugaaagucaucugguucuccucucugaucugcuuagucauucaaugugguggggauacaggcccaaucaucugcgcaggacccauccacucaaacaagagugcugacauaccucaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuucuuugaacggccaacuuuugauggauacguuggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaagauugauggcauuguguucaaccagugugggggugagagucuaccucagcccuuugauguugcauggauggauguuggccacucucacaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaauuccacucaggaucauugguuggaaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauaggggaaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuaaacuuguuucgugcaggcaaggaagcggaaauaugaaggaaugugucacaacugggagggcgcuucuuccugcggugaacccagggcaagaggcgugucugcacuucacggcaccuggaaguccagacucaaaaugucucaaaauuaagguuaagaagaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucagcggcugcucugauggauguggaggagcagccugcgguugcuuuaaugcggccccuucaugcauuuucuggaggaaauggguagagaauccacaugggaucaucuggaaagucucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucgugggcauagagcuacgaguggaugacgcuguguguuacucuaagaucacuaguguggaggcaguugcaaacuacucugcuauacccaccacuauuggggggcugagguuugagagaagccaugacagccaggguaaaauaucugguagcccccuggacaucacagcuauaagaggaucuuuuucugucaauuauagaggccuucgacugagucucucagaaauuacugcuacguguacaggggaagugacaaaugugaguggguguuauucaugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacuguggggggcaugagagucauguaacucugaaagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggugugauagggguccuacuggggggauuggcucucuuuuucuugaucaugucuuuguucaagcugggaacaaaacagguauuucgaucgaggacgaagcuggcuuag

SEQ ID NO: 4896 - RNA, 3222 nt, Artificial Sequence
  derived and/or modified CDS sequence (wt) from SFTSV/Phlebovirus(JS4/China/2010 strain JS4)__HQ141605.1__GP
augaugaaagucaucugguucuccucucugaucugcuuugucauucaaugcaguggggacucgggcccaaucaucugcgcaggacccauucacucaaacaagagugcugacauaccccaccugcuugguuacucugagaagauuugucagauagaucggcugauacauguuucgucauggcucagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccuggaccuucauacaaggggaaagucuuuuuugaacggccaacuuuugauggauauguaggcuggggcuguggcagugggaagucuaggacugagucaggagagcucugcaguucagacucagggacuaguucuggucuucuacccucggauaggguucucuggauaggugauguugcuugucaaccuaugacaccuaucccugaggagacauuccuggagcugaagagcuuuagccaaagugaauucccagacauauguaaaauugauggcauuguguucaaccagugugaaggugagagucuaccucagcccuuugauguugcauggauggauguuggccacucucacaaaaucaucaugagggagcacaagaccaaauggguacaagagagcucauccaaggauuuugugugcuacaaggaagggacugggccuuguucagaaucagaagaaaagacuugcaagaccagugggucaugcaggggggacaugcaguuuugcaagguggcuggaugugaacauggggaagaggcaucugaagccaaguguagaugcucacuugugcacaagcccggggaagucguugugucuuauggagggaugcgugucagaccaaagugcuauggauucucuagaaugauggcaacacuggagguaaacccaccagagcaaaggauuggucaaugcacuggcugccaucuagaaugcauaaacgggggugugaggcuaaucacucuaaccagugagcucaagucagcuacugucugugcuucccacuuuuguaguucugccacaagugguaagaaaagcacggaaauucaauuccacucaggaucauuggucgggaaaacagcgauacacgucaaaggggcauugguagaugggacugaauucacauuugaggguaguugcauguucccagaugguugcgaugcaguggacugcacauucugucgugaguuucuaaaaaauccacagugcuacccugcaaagaaguggcuguuuaucauuauugucauccuccuuggauaugcaggccucaugcuacucaccaauguccucaaggcaauugggguuugggggucaugggucauagcuccagugaagcuacuguuugccaucauaaagaaacuaaugagaacuguaagcugcuugauggggaaauugauggauaggggaaggcaagugauccaugaggaaauaggggagaauagagagggcaaccaagaugauguuaggaucgagauggcaagacccagaaggguaaggcauuggauguacucaccugucauccugacuauucuagcaauagggcuugcugagggcugugaugagaugguccaugcugauucuaaacuuguuucaugcaggcaagggagcgaaaauaugaaggaaugugucacaacugggagggcgcuucuuccugcagugaacccaggucaagaggcaugucugcacuucacggcaccugggaguccggacucaaaaugucucaaaauuaagguaaagaggaucaaccuaaaauguaagaagucaucaucauauuuuguuccugaugcccggucuagguguacaucagugaggagaugucguugggcaggagacugccagucugggugucccccucauuucacauccaacuccuuuucugaugauugggcaggcaagauggacagggcuggucuaggauucaguggcugcucugauggauguggaggagcagccugcggcugcuuuaaugcggccccuucaugcaucuucuggaggaaauggguagagaauccacaugggaucaucuggaaaguaucuccaugugccgcaugggucccaucggcaguuauagagcuaacaaugcccucaggggaggugaggacauuccaccccaugaguggcauccccacacaagucuucaagggugugaguguaacuuacuuggguucagauauggaggugucuggcuugacagaucuuugugagauagaagagcucaaguccaagaagcuggcauuagcucccugcaaccaggcuggcauggggguuguaggcaagguuggagagauacagugcaguagugaggaaagugcccguaccauaaaaaaagaugggugcauauggaaugcagaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagcuauaagaggaucuuuuucuguuaauuauagaggccuucgucugagucucucagaaauuacugcuacuugcacaggggagguuacaaaugugaguggguguuauucuugcaugacaggcgccaaagucuccaucaaauuacauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagccaagugacucuaaaagguaaccucaucuuccuggaugucccaaaauuuguggauggcagcuacaugcagacauaucacaguacugugcccacaggggcaaauaucccaagcccuacagauuggcugaaugccuuguuuggcaaugggcugaguagguggauucugggggugauagggguucuacuugggggauuggcucucuuuuucuugauuaugucuuuguucaagcugggaacaaaacagguauuucgaucaaggacgaagcuggcuuag

SEQ ID NO: 4897 - RNA, 3222 nt, Artificial Sequence
  derived and/or modified CDS sequence (wt) from SFTSV/Phlebovirus(JS6)__HQ830170.1__GP
augaugaaagucaucugguucuccucucugaucugcuuagucauucaaugcgguggggauacaggcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgaucucaggugagcuacuacccagcugaaaauucuuacucaagguggaguggacuucuaagccccugugaugcugauuggcuugggaugcuuguugugaagaaggccaaggggucugauaugauaguuccagggccuucauacaaggggaaagucuuuuuugaacggccaacuuuugauggauacguaggcuggggcugugguagugggaagucuaggacugagucaggugagcucugcaguucagacuccgggacuaguucuggucuucugcccucagauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucagcccuuugauguugcauggauggauguuggccacucucauaaaaucaucaugagggagcacaagaccaaauggguacaagagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaagugcagaugcucacuugugcacaagcccggggaagucguugugucauauggagggaugcgugucagaccaaagugcuaugguuucuccagaaugauggcaacacuggaggugaacgaaccagagcagaggauuggucaaugcacuggcugccaacuagaaugcauaaaugggggugugaggcuaaucacucuaaccagugagcucaagucagcuacugucugcgcuucucacuucuguaguucugccacaagugguaagaaaagcacggagauucaauuccacucaggaucauugguugggaaaacagcaauccacgucaaaggggcauugguagauggaacugaauucacauuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauagaggaaggcaagugauccaugaggaaauaggggagaauagagagggcaaccaagaugauguuaggauugagauggccagacccaggaggguaaggcauuggauguacucgccugucauccugacuauucuagcaauggggcuugcugagggcugugaugagaugguccaugcugauucuaaacuuguuucgugcaggcaagggagcggaaauaugaaggaaugugucacaacugggagggcgcuucuuccugcagugaacccagggcaagaggcgugucugcacuucacggcaccuggaaguccggacucaaaaugucucaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugugguugcuuuaaugcggccccuucuugcauuuucuggaggaaauggguagagaauccacaugggaucaucuggaaaguaucuccaugugcugcaugggucccaucagcgguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacggguggaugacgcugugugcuacucuaagaucacuaguguggaggcaguugcaaacuacuccgccauacccaccacuauuggggggcugagguuugagagaagccaugacagccagggcaaaauaucugguagcccccuggacaucacagcuauaagaggaucuuuuucuaucaauuauagaggccuucgacugagccucucagaaauuacugcuacuugcacaggggaagugacaaaugugaguggguguuauucuugcaugacaggcgccaaagucuccaucaaguugcauagcagcaaaaauagcacugcccauguaagaugcaaaggggaugagacugccuucagugucuuggagggaguccauagcuacucugucagucucaguuuugaucaugcaguaguugaugagcagugccaacugaacugugggggacaugagagucaagugacucugagaggcaaccucaucuuccuggaugucccgaaauuuguggauggcagcuacaugcagacauaucauagcacugugcccacaggggcaaauaucccaagcccuacagauuggcuaaaugccuuguuuggcaaugggcugaguagguggauccugggggugauagggguccuacuggggggauuggcucucuuuuucuugaucaugucuuuguucaagcugggaacaaaacagguauuucgaucgaggacgaagcuggcuuaa

SEQ ID NO: 4898 - RNA, 3222 nt, Artificial Sequence
  derived and/or modified CDS sequence (wt) from SFTSV/Phlebovirus(JSD1)__JF267784.1__GP
augaugaaagucaucugguucuccucucugaucugcuuugucauucaaugcaguggggacucgggcccaaucaucugugcaggacccauccacucaaacaagagugcugacauaccucaccugcuggguuacucugagaagauaugucagauagaucgacugauacauguuucgucauggcucagaaaccacucacaauuucaggguuacguagggcagcgagguggacgcucucaggugagcuacuacccagcugaaaauucucacucaagguggagugggcuucuaagccccugugaugcugauuggcuugggaugcuuguugugaagaaggccaaggggucugacaugauaguuccugggccuucauacaaggggaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaagagacauuucuggagcugaagaguuuuagccaaagugaauucccagacauaugcaaaauugauggcauuguguuuaaccagugugagggugagagucuaccucagccuuuugauguugcauggauggauguuggccacucucauaaaaucaucaugagggagcacaagaccaaaugggugcaagagagcucauccaaggauuuugugugcuauaaggaagggacugggccuuguucugaaucagaagaaaagacuugcaagaccaguggaucaugcaggggggacaugcaguucugcaagguugcagguugugaacauggggaagaggcaucugaagccaaguguagaugcucacuuguacacaagcccggagaagucguugugucauauggagggaugcgugucagaccaaagugcuaugguuucuccagaaugauggcaacacuggaggugaaccaaccagagcaaaggauuggccaaugcacuggcugccaucuagaaugcauaaaugggggugugaggcuaauaacccuaaccagugagcucaagucagcuacugucugugcuucccacuuuuguaguucugccacgaguggcaagaaaagcacggagauucaauuccacucaggaucauugguugggaaaacagcaauacacgucaaaggggcauugguagauggaacugaauucacauuugaggguaguugcauguucccagaugguuguaaugcgguggacugcacuuucugucgugaguuucuaaaaaauccccagugcuacccugcaaagaaguggcuguucaucauuauugucauccuccuuggauaugcaggccucaugcuacucaccaauguccucaaggcaauugggauuuggggaucaugggucauagcuccagugaagcuaauguuugccaucauaaagaaacuaaugagaacugugagcugcuugauggggaaauugauggauaggggaagacaagugauccaugaggagauaggggagaauagagagggcaaccaagaugauguuaggauugagauggcaagacccagaaggguaaggcauuggauguacucaccugucauccuaacuuuuuuagcaauagggcuugcugagagcugcgaugagaugguccaugcugauucuaagcuuguuucaugcaggcaagggagcggaaauaugaaggaaugugucacaacugggagggcgcuucuuccugcggugaacccaggucaagaggcaugucugcacuucacggcgccugggaguccggacucaaaaugucucaaaauuaagguuaagaggaucaaccuaaaauguaagaagucaucaucauauuuuguuccugaugcccgguccagguguacaucagugaggagaugucguugggcuggagacugccagucugggugccccccccauuucacauccaacuccuuuucugaugauugggcagguaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcauccccacacaagucuucaagggugugagugugacuuacuuaggcucagauauggaggugucuggcuugacagaccuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguagaugacgcugugugcuacucuaagaucacuaguguggaagcaguugcaaacuacucugccauacccaccacuauuggggggcugagguuugagagaagccaugacagccaggguaaaauaucugguagcccccuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaaacugcacagcagcaaaaauagcacugcccauguaagaugcaaaggggaugagacagcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggaugguagcuacaugcagacauaucauagcacugugcccacaggggcaaauaucccaagcccaacagacuggcugaaugccuuguuuggcaaugggcugagcagguggauccugggggugauagggguucugcuugggggguuggcucucuuuuucaugauuaugucuuuguucaagcugggaacaaaacagguauuucgaucaaggacaaagcuggcuuag

SEQ ID NO: 4899 - RNA, 3222 nt, Artificial Sequence
  derived and/or modified CDS sequence (wt) from SFTSV/Phlebovirus(LN2/China/2010 strain LN2)__HQ141608.1__GP
augaugaaagucaucugguucuccucucugaucugcuuugucauucaaugcaguggggacucgggcccaaucaucugcgcaggacccauccauucaaacaagagugcugacauaccucaccugcuggguuacucugagaagauaugucagauagaucggcugauacauguuucgucauggcucagaaaccacucacaauuucagggcuacguagggcagcgaggaggacgcucucaggugagcuacuacccagcugaaaauucuuacucaagguggagugggcuucuaagccccugugaugcugauuggcuugggaugcuugucgugaagaaggccaaggggucugauaugauaguuccugggccuucauacaagggaaaagucuuuuuugagcggccaacuuuugauggauauguaggcuggggcuguggcagugggaagucuaggacagagucaggagagcucugcaguucagacucagggacuagcucuggucuucugcccucagauaggguucucuggauaggugauguugcuugucagccuaugacacccaucccugaggagacauuucuggagcugaagaguuuuagccaaagugaauucccagacauaugcagaauugauggcauuguguucaaccagugugagggugagagucuaccucagcccuuugauguugcauggauggauguuggccacucucauaaaaucaucaugagggagcacaagaccaaaugggugcaagagagcucauccaaggauuuugugugcuacaaggaagggacugggccuuguucugaaucagaagaaaagacuugcaagaccaguggaucaugcaggggggacaugcaguucugcaagguagcagguugugaacauggggaagaggcaucugaagccaaguguagaugcucacuuguucacaagcccggagaagucguugugucauauggagggaugcgugucagaccaaagugcuaugguuucuccagaaugauggcaacacuggaggugaaccaaccagugcaaaggauuggucaaugcacuggcugccaucuggaaugcauaaaugggggugugaggcuaauaacucuaaccagugagcucaagucagcuacugucugugcuucccacuuuuguaguucugccacgaguggcaagaaaagcacggagauacaauuccacucaggaucauugguugggaaaacagcaauacacgucaaaggggcauugguagauggaacugaauucacauuugaggguagcugcauguucccggaugguugugaugcgguggacugcacuuucugucgugaguuucuaaaaaauccucagugcuacccugcaaagaaguggcuguucaucauuauugucauccuccuuggauaugcaggccucaugcuacucaccaauguccucaaggcaauuggaauuuggggaucaugggucauagcuccagugaagcuaauauuugccaucauaaagaaacuaaugagaacugugagcugcuugauggggaaauugauggauaggggaaggcaagugauccaugaggagauaggggagaauagagagggcaaccaagaugauguuaggauugagauggcaagacccagaaggguaaggcauuggauguacgcaccugucauccugacuauuuuagcaauggggcuugcugagagcugugaugagaugguccaugcugauucuaagcuuguuucaugcaggcaagggagcggaaauaugaaggaaugugucacaacugggagggcgcuucuuccugcggugaacccaggucaagaggcaugucugcacuucacggcaccugggaguccggacucaaaaugucucaaaauuaagguuaagaggaucaaccuaaaaugcaagaagucaucaucauauuuuguuccugaugcccgguccagauguacaucagugaggagaugucguugggcuggagacugccagucagggugccccccucauuucacauccaacucuuuuucugaugauugggcaggcaagauggacagggcuggucuaggguucaguggcugcucugauggauguggaggagcagccugcggcugcuuuaaugcagccccuucaugcaucuucuggaggaaauggguagagaacccacaugggaucaucuggaaaguaucuccuugugccgcaugggucccaucggcagucauagagcuaacaaugcccucaggggaggugaggacauuccaccccaugaguggcaucccuacacaagucuucaagggugugagugugacuuacuugggcucagauauggaggugucuggcuugacugacuuaugugagauagaggagcucaaguccaagaagcuggcauuagcucccugcaaccaggcuggcauggggguuguaggcaagguuggagagauacagugcaguagcgaggaaagugcccguaccauaaaaaaagaugggugcauauggaaugcagaccuugugggcauagagcuacgaguggaugaugcugugugcuacucuaagaucacuaguguagaagcaguugcaaacuacucugccauacccaccacuauuggggggcugagguuugagagaagccaugacagccaggguaaaauaucugguagcccucuggacaucacagcuauaagaggaucuuuuucuguuaauuauagaggccuucgacugagccucucagaaauuacugcuaccugcacaggggaggugacaaaugugaguggauguuauucuugcaugacaggcgccaaagucucuaucaagcugcauaguagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagucaagugacucuaaaaggcaaccuuaucuuccuggaugucccaaaauuuguggauggcagcuacaugcagacauaucauagcacugugcccacaggggcaaauaucccaagcccaacagacuggcugaaugccuuguuuggcaaugggcugaguagguggauccugggggugauagggguucugcuugggggauuggcucucuuuuucaugaucaugucuuuguucaagcugggaacaaaacagguauuucgaucaaggacgaagcuggcuuag

SEQ ID NO: 4900 - RNA, 3222 nt, Artificial Sequence
  derived and/or modified CDS sequence (wt) from SFTSV/Phlebovirus(LN3/China/2010 strain LN3)__HQ141611.1__GP
augaugaaagucaucugguucuccucucugaucugcuuagucauucaaugugguggggauacgggcccaaucaucugcgcaggacccauccacucaaacaagagugcugacauaccccaccugcuuggcuacucugagaagauuugucagauagaucggcugauacauguuucgucauggcuuagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccugggccuucauacaaggggaaagucuuuuuugaacggccaacuuuugauggauacguaggcuggggcugugguagugggaagucuaggacugagucaggugagcucugcaguucagacucugggacuaguucuggucuucugcccucggauaggguucucuggauaggugauguugcuugucagccuaugacacccaucccugaggagacauuucuggagcugaagagcuuuagccaaagugaauucccagacauaugcaaaauugauggcauuguguucaaccagugugagggugagagucuaccucagcccuuugauguugcauggauggauguuggccacucucauaaaaucaucaugagagagcacaagaccaaauggguacaggagagcucauccaaggauuuugugugcuacaaggaagggacugggccuuguucugaaucagaagaaaagacuugcaagaccaguggaucaugcaggggggacaugcaguuuugcaagguggcagguugugaacauggggaagaggcaucugaagccaaguguagaugcucacuugugcacaagcccggggaagucguugugucauauggagggaugcgugucagaccaaagugcuaugguuucuccagaaugauggcaacacuggaggugaaccaaccagagcaaaggauuggucaaugcacuggcugccaucuagaaugcauaaaugggggugugaggcuaaucacucuaaccagugagcucaagucagcuacugucugcgcuucucacuuuuguaguucugccacaagugguaagaaaagcacggagauucaguuccacucaggaucauugguugggaaaacagcaauccacgucaaaggggcauugguagauggaacugaauucacuuuugaggguaguugcauguucccagaugguugugaugcaguggacugcacauucugucgugaguuucuaaaaaauccccagugcuacccugcaaagaaguggcuguucaucauuauugucauccuccuuggauaugcaggccucaugcuacucaccaauguucuuaaggcaauugggguuugggggucaugggucauagcuccagugaagcuaguguuugccaucauaaagaaacuaaugagagcugugagcugccugauggggaaauugauggauagggggaggcaagugauccaugaggaaauaggggagaauagagagggcaaccaagaugauguuaggauugagauggccagacccaggaggguaaggcauuggauguacucgccugucauccugacuauucuagcaauagggcuugcugagggcugugaugagaugguccaugcugauucuagacuuguuucgugcaggcaaggaagcggaaauaugaaggaaugugucacaacugggagggcgcuucuuccugcggugaacccagggcaagaggcgugucugcacuucacggcaccuggaaguccggacucaaaaugucuuaaaauuaagguuaagaggaucaaccuaaaauguaaaaagucaucaucauauuuuguuccugaugcccgguccagguguacaucagugaggagaugucguugggcaggggacugccagucugggugccccccucauuucacauccaacuccuuuucugaugauugggcagguaagauggacagggcuggucuaggauucaguggcugcucugauggauguggaggagcagccugcgguugcuuuaaugcggccccuucaugcauuuucuggaggaaauggguagagaauccacaugggauuaucuggaaaguaucuccaugugccgcaugggucccaucagcaguuauagagcuaacaaugcccucaggggaggugaggacauuccaccccaugagcggaauccccacacaagucuucaagggugugaguguaacuuacuugggcucagauauggaggugucaggcuugacugaccugugugagauagaagagcucaagucaaagaagcuugcauuagcucccugcaaccaggcugguauggggguuguaggcaagguuggagagauacagugcaguagcgaggaaagugcccguaccauaaaaaaagaugggugcauauggaaugcugaccucguggguauagagcuacgaguggaugacgcugugugcuacucuaagaucacuaguguggaggcaguugcaaacuacucugccauacccaccacuauuggggggcugagguuugagagaagccaugacagccagggcaaaauaucugguagcccccuggacaucacagcuauaagaggaucuuuuucugucaauuauagaggccuucgacugagucucucagaaauuacugcuacguguacaggggaaguaacaaaugugaguggguguuauucaugcaugacaggcgccaaagucuccaucaaguugcauagcagcaaaaauagcacugcccauguaagaugcaaaggggacgagacugccuucagugucuuggagggaguccauagcuacucugucagucucaguuuugaucaugcaguaguugaugagcagugccaacugaacuguggggggcaugagagucaugugacucugagagguaaccucaucuuccuggaugucccgaaauuuguggauggcagcuacaugcagacauaucauaguacugugcccacaggggcaaauaucccaagcccuacagauuggcuaaaugccuuguuuggcaaugggcugaguagguggauucugggggugauagggguccuacuggggggauuggcucucuuuuucuugaucaugucuuuguucaagcugggaacaaaacagguauuucgaucgaggacgaagcuggcuuag

SEQ ID NO: 4901 - RNA, 3222 nt, Artificial Sequence
  derived and/or modified CDS sequence (wt) from SFTSV/Phlebovirus(SD24/China/2010 strain SD24)__HM802201.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagaacucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauauugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagacggguaaggcauuggauguacucaccugucauccugaccauucuagcaauagggcuugcugagggcugugaugaaaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcucgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 4902 - RNA, 3222 nt, Artificial Sequence
  derived and/or modified CDS sequence (wt) from SFTSV/Phlebovirus(SD4/China/2010 strain SD4)__HM802203.1__GP
augaugaaagucaucugguucuccucucugaucugcuuugucauucaaugcaguggggacucgggcccaaucaucugcgcaggacccauucacucaaacaagagugcugacauaccccaccugcuugguuacucugagaagauuugucagauagaucggcugauacauguuucgucauggcucagaaaccacucacaauuucagggcuacguagggcagcgagguggacgcucucaggugagcuacuacccagcugaaaauucuuacucaagguggaguggacuucuaagccccugugaugcugauuggcuugggaugcuugucgugaagaaggccaaggggucugauaugauaguuccuggaccuucauacaaggggaaagucuuuuuugaacggccaacuuuugauggauauguaggcuggggcuguggcagugggaagucuaggacugagucaggagagcucugcaguucagacucagggacuaguucuggucuucuacccucggauaggguucucuggauaggugauguugcuugucaaccuaugacaccuaucccugaggagacauuccuggagcugaagagcuuuagccaaagugaauucccagacauauguaaaauugauggcauuguguucaaccagugugaaggugagagucuaccucagcccuuugauguugcauggauggauguuggccacucucacaaaaucaucaugagggagcacaagaccaaauggguacaagagagcucauccaaggauuuugugugcuacaaggaagggacugggccuuguucagaaucagaagaaaagacuugcaagaccagugggucaugcaggggggacaugcaguuuugcaagguggcuggaugugaacauggggaagaggcaucugaagccaaguguagaugcucacuugugcacaagcccggggaagucguugugucuuauggagggaugcgugucagaccaaagugcuauggauucucuagaaugauggcaacacuggagguaaacccaccagagcaaaggauuggucaaugcacuggcugccaucuagaaugcauaaacgggggugugaggcuaaucacucuaaccagugagcucaagucagcuacugucugugcuucccacuuuuguaguucugccacaagugguaagaaaagcacggaaauucaauuccacucaggaucauuggucgggaaaacagcgauacacgucaaaggggcauugguagaugggacugaauucacauuugaggguaguugcauguucccagaugguugcgaugcaguggacugcacauucugucgugaguuucugaaaaauccacagugcuacccugcaaagaaguggcuguuuaucauuauugucauccuccuuggauaugcaggccucaugcuacucaccaauguccucaaggcaauugggguuugggggucaugggucauagcuccagugaagcuacuguuugccaucauaaagaaacuaaugagaacuguaagcugcuugauggggaaauugauggauaggggaaggcaagugauucaugaggaaauaggggagaauagagagggcaaccaagaugauguuaggaucgagauggcaagacccagaaggguaaggcauuggauguacucaccugucauccugacuauucuagcaacagggcuugcugagggcugugaugagaugguccaugcugauucuaaacuuguuucaugcaggcaagggagcggaaauaugaaggaaugugucacaacugggagggcgcuucuuccugcagugaacccaggucaagaggcaugucugcacuucacggcaccugggaguccggacucaaaaugucucaaaauuaagguaaagaggaucaaccuaaaauguaagaagucaucaucauauuuuguuccugaugcccggucuagguguacaucagugaggagaugucguugggcaggagacugccagucugggugucccccucauuucacauccaacuccuuuucugaugauugggcaggcaagauggacagggcuggucuaggauucaguggcugcucugauggauguggaggagcagccugcggcugcuuuaaugcggccccuucaugcaucuucuggaggaaauggguagagaauccacaugggaucaucuggaaaguaucuccaugugccacaugggucccaucggcaguuauagagcuaacaaugcccucuggggaggugaggacauuccaccccaugaguggcauccccacacaagucuucaagggugugaguguaacuuauuuggguucagauauggaggugucuggcuugacagaucuuugugagauagaagagcucaaguccaagaagcuggcauuagcucccugcaaccaggcuggcauggggguuauaggcaagguuggagagauacagugcaguagugaggaaagugcccguaccauaaaaaaagaugggugcauauggaaugcagaccuugugggcauagagcuacgaguggaugacgcugugugcuacucuaagaucacuaguguggaggcaguugcaaacuacucugccauacccaccacuauuggggggcugagguuugagagaagccaugacagccaggguaaaauaucugguagcccccuagacaucacagcuauaagaggaucuuuuuccguuaauuauagaggccuucgucugagucucucagaaauuacugcuacuugcacaggggagguuacaaaugugaguggguguuauucuugcaugacaggcgccaaagucuccaucaaauuacauagcagcaaaaauagcacugcccauguaagaugcaaaggggaugagacugcauucagugucuuggaggggguccauagcuacacugucagucucaguuuugaccaugcaguagucgaugagcagugccaacugaacugugggggacaugagagccaagugacucuaaaagguaaccucaucuuccuggaugucccaaaauuuguggauggcagcuacaugcagacauaucacaguacugugcccacaggggcaaauaucccaagcccuacagauuggcugaaugccuuguuuggcaaugggcugaguagguggauucugggggugauagggguucuacuugggggauuggcucucuuuuucuugauuaugucuuuguucaagcugggaacaaaacagguauuucgaucaaggacgaagcuggcuuag

SEQ ID NO: 4903 - RNA, 3222 nt, Artificial Sequence
  derived and/or modified CDS sequence (wt) from SFTSV/Phlebovirus(SDYY104/China/2011)__KU239112.1__GP
augaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggccaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaauaguuuuagccaaagugaauucccagacauauguaaaauugauggcauuguguucaaccagugugagggugagaguuuaccccagcccuuugauguugcauggauggauguuggccacucccauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggaugcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccacaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcugagggcugugaugagaugguccaugcugauucuaaacuuguuucaugcagacaagggagcggaaauaugaaggaaugcaucacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccuaugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaaugcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugaguggguguuauuccugcaugacaggcgccaaagucuccaucaaauugcauagcagcaaaaauagcacugcccauguuagaugcaaaggggaugagacugcauucagugucuuggagggaguccauagcuacauugucagccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucguguuuuugcucaagcugggaacaaaacaggcauuucgaucgaggacgaagcuggcuuag

SEQ ID NO: 4904 - RNA, 1287 nt, Artificial Sequence
  derived and/or modified CDS sequence (opt4) from ANDV(Chile-9717869)__AF291702.1__N
augagcacccugcaggagcugcaggagaacaucaccgcccacgagcagcagcuggugaccgccagacagaagcugaaggacgccgagaaggccguggagguggaccccgacgacgugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggacagaaucgaggaguuccuggccgccgagugccccuuccugcccaagcccaagguggccagcgaggccuucaugagcaccaacaagauguacuuccugaacagacagagacaggugaacgagagcaaggugcaggacaucaucgaccugaucgaccacgccgagaccgagagcgccacccuguucaccgagaucgccaccccccacagcguguggguguucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4905 - RNA, 1287 nt, Artificial Sequence
  derived and/or modified CDS sequence (opt4) from ANDV(Nort)__AF325966.1__N
augagcacccugcaggagcugcaggagaacaucaccgcccacgagcagcagcuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgccgagugccccuuccugcccaagcccaaggcccugagcgaggccuucauggccaccaacaaggccuacuuccugaacagacagagacaggugaacgacagcaaggugcaggacaucguggaccugaucgaccacgccgagaucgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccaguacaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4906 - RNA, 1287 nt, Artificial Sequence
  derived and/or modified CDS sequence (opt4) from ANDV(CHI-7913)__AY228237.1__N
augagcacccugcaggagcugcaggagaacaucaccgcccacgagcagcagcuggugaccgccagacagaagcugaaggacgccgagaaggccguggagguggaccccgacgacgugaacaagagcacccugcagaacagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacaggccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggacagaaucgaggaguuccuggccgccgagugccccuuccugcccaagcccaagguggccagcgaggccuucaugagcaccaacaagauguacuuccugaacagacagagacaggugaacgagagcaaggugcaggacaucaucgaccugaucgaccacgccgagaccgagagcgccacccuguucaccgagaucgccaccccccacagcguguggguguucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4907 - RNA, 1287 nt, Artificial Sequence
  derived and/or modified CDS sequence (opt4) from ANDV(9718133)__AF482712.1__N
augagcacccugcaggagcugcaggagaacaucaccgcccacgagcagcagcuggugaccgccagacagaagcugaaggacgccgagaaggccguggagguggaccccgacgacgugaacaagagcacccugcagaacagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggacagaaucgaggaguuccuggccgccgagugccccuuccugcccaagcccaagguggccagcgaggccuucaugagcaccaacaagauguacuuccugaacagacagagacaggugaacgagagcaaggugcaggacaucaucgaccugaucgaccacgccgagaccgagagcgccacccuguucaccgagaucgccaccccccacagcguguggguguucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4908 - RNA, 1278 nt, Artificial Sequence
  derived and/or modified CDS sequence (opt4) from Araraquara virus(9480)__KP202360.1__N
augagcaaccugcaggagcugcaggagaacaucaccgcccacgagcagcagcuggugaccgccagacagaagcugaaggacgccgagaaggccguggacguggaccccgacgaggugaacaagagcacccugcagggcagaagagccgccgugagcacccuggagaccaagcugggcgagcugaagagacagcuggccgaccugguggccgcccagagacuggccagcaagcccguggaccccaccggcaucgagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacaucagcaugcccaccgcccagagcaccaugaaggccgaggagaucacccccggcagauucagaaccaucgccugcggccuguuccccgcccaggugaaggccagaaacaucaucagccccgugaugggcgugaucggcuucgccuucuucgugaaggacuggauggagagaaucgaggacuuccuggccagcgagugccccuuccugcccaagcccaagaaccccagcgaggccuucauggccaccaacaaggccuacuuccugaacagacagaagcagguggacgagagccaggugcccgacaucguggaccugaucgaccacgccgaggccgagagcgccacccuguucaaggagaucgccagcccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagagccagaccaagagccuguga

SEQ ID NO: 4909 - RNA, 1287 nt, Artificial Sequence
  derived and/or modified CDS sequence (opt4) from Araraquara-like virus(P5/Cajuru)__EF571895.1__N
augagcaaccugcaggagcugcaggagaacaucaccgcccacgagcagcagcuggugaccgccagacagaagcugaaggacgccgagaaggccguggacguggaccccgacgaggugaacaagagcacccugcagggcagaagagccgccgugagcacccuggagaccaagcugggcgagcugaagagacagcuggccgaccugguggccgcccagagacuggccagcaagcccguggaccccaccggcaucgagcccgacgaccaccugaaggagaagagcagccugagauacggcaacgugcuggacgugaaccccaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacaucagcaugcccaccgcccagagcaccaugaaggccgaggagaucacccccggcagauucagaaccaucgccugcggccuguuccccgcccaggugaaggccagaaacaucaucagccccgugaugggcgugaucggcuucggcuucuucgugaaggacuggauggagagaaucgaggacuuccuggccagcgagugccccuuccugcccaagcccaagaaccccagcgaggccuucauggccaccaacaaggccuacuuccugaacagacagaagcagguggacgagagccaggugcccgacaucguggaccugaucgaccacgccgaggccgagagcgccacccuguucaaggagaucgccagcccccacagcguguggguguucgccugcgcccccgacagaugcccccccaccgcccuguacguggccggccugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccagggcccccugaagcuguga

SEQ ID NO: 4910 - RNA, 1287 nt, Artificial Sequence
  derived and/or modified CDS sequence (opt4) from BMJV(Oc22531)__AF482713.1__N
augagcacccugcaggagcugcaggagaacaucaccgcccacgagcagcagcuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggagaagcaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgccgagugccccuuccugcccaagcccaaggcccccagcgaggccuucauggccaccaacaaggccuacuuccugaacagacagagacaggugaacgagagcaaggugcaggacaucguggaccugaucgaccacgccgagaccgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4911 - RNA, 1287 nt, Artificial Sequence
  derived and/or modified CDS sequence (opt4) from LECV(22819)__AF482714.1__N
augagcacccugcaggagcugcaggagaacaucaccgcccacgagcagcagcuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggagaagcaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgccgagugccccuuccugcccaagcccaaggcccccagcgaggccuucauggccaccaacaaggccuacuuccugaacagacagagacaggugaacgagagcaaggugcaggagaucguggaccugaucgaccacgccgagaccgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4912 - RNA, 1287 nt, Artificial Sequence
  derived and/or modified CDS sequence (opt4) from MCLV(13796)__AF482716.1__N
augagcaaccugcaggagcugcaggagaacaucaccgcccacgagcagcagcuggugaccgccagacagaagcugaaggacgccgagaaggccguggacguggaccccgacgaggugaacaagagcacccugcagggcagaagagccgccgugagcacccuggagaccaagcugggcgagcugaagagacagcuggccgaccugguggccgcccagaagcuggccaccaagcccguggaccccaccggcaucgagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacaucagcaugcccaccgcccagagcaccaugaaggccgaggagaucacccccggcagauucagaaccaucgugugcggccuguuccccgcccaggugaaggccagaaacaucaucagccccgugaugggcgugaucggcuucagcuucuucgugaaggacuggauggagagaaucgagggcuuccuggccgccgagugccccuuccugcccaagcccaagaccgccgccgagaccuucauggccaccaacaaggccuacuucuucaacagacagagacagguggacgagagccaggugcccgacaucguggagcugaucgaccaggccgagagcgagagcgccacccuguucaccgagaucgccagcccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccaggcccugaucgacaccaaggugaaggagaucagcaaccaggagccccugaagcuguga

SEQ ID NO: 4913 - RNA, 1287 nt, Artificial Sequence
  derived and/or modified CDS sequence (opt4) from Neembucu(Neembucu)__DQ345763.1__N
augagcacccugcaggagcugcaggagaacaucaccgcccacgagcagcagcuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccaccagacccguggaccccaccggccuggagcccgacgaccaccugaaggagaagagcagccugagauacggcaacgugcuggacgugaacagcaucgaccuggaggagcccagcggccagaccgccgacuggagaagcaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagacugagaaccaucgccugcggccuguuccccgcccaggugaaggccagaagcaucaucagccccgugaugggcgugaucggcuucagcuucuucgugaaggacuggauggagagaaucgaggacuuccuggccgccgagugccccuuccugcccaagcccaaggcccccagcgaggccuucauggccaccaacaaggccuacuuccugaacagacagagacaggugaacgagagcaaggugcaggacaucguggaccugaucgaccacgccgagaccgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4914 - RNA, 1287 nt, Artificial Sequence
  derived and/or modified CDS sequence (opt4) from ORNV(22996)__AF482715.1__N
augagcacccugcaggagcugcaggagaacaucaccgcccacgagcagcagcuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgccgagugccccuuccugcccaagcccaaggcccugagcgaggccuucauggccaccaacaaggccuacuuccugaacagacagagacaggugaacgacagcaaggugcaggacaucguggaccugaucgaccacgccgagaucgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagagccugaucgacaccaaggugaaggagaucagcaaccaggagccccugaagcuguga

SEQ ID NO: 4915 - RNA, 1287 nt, Artificial Sequence
  derived and/or modified CDS sequence (opt4) from PRGV(14403)__AF482717.1__N
augagcacccugcaggagcugcaggagaacaucaccgcccacgagcagcaccuggugaccgccagacagaagcugaaggacgccgagaagaccguggagguggaccccgacgaggugaacaagagcacccugcagagcagaagagccgccgugagcacccuggagaccaagcugggcgagcugaagagacagcuggccgaccugguggccgcccagaagcuggccgccaagcccguggaccccaccggccuggagcccgacgaccaccugaaggagaagagcagccugagauacggcaacgugcuggacgugaacagcaucgaccuggaggagcccagcggccagaccgccgacuggaaggccaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgccgagugccccuuccugcccaagcccaagaccaccagcgaggccuucaugagcaccaacaaggccuacuuccugaacagacagagacagguggacgagagccaggugcccgacaucgccgagcugaucgagcaggccgagagcgagagcgccacccuguucaccgagaucgccagcccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccaggcccugaucgacaccaaggugaaggagaucagcaaccaggagccccugaagcuguga

SEQ ID NO: 4916 - RNA, 1287 nt, Artificial Sequence
  derived and/or modified CDS sequence (opt4) from TUNV(FVB554)__JF750419.1__N
augagcaaccugcaggagcugcaggagaacaucaccgcccacgagcagcagcuggugaccgccagacagaagcugaaggacgccgagaaggccguggagauggaccccgacgacgugaacaagagcacccugcagagcagaagagccgccgugagcacccuggagaccaagcugggcgagcugaagagacagcuggccgacaugguggccgcccagaagcuggccaccaagcccguggaccccaccggccuggagcccgacgaccaccugaaggagaagagcagccugagauacggcaacgugcuggacgugaacagcaucgaccuggaggagcccagcggccagaccgccgacuggaagagcaucggcgccuacauccugggcuucgccauccccaucauccugaaggcccuguacaugcugagcaccagaggcagacagaccgugaaggacaacaagggcaccagaaucagauucaaggacgacagcagcuucgaggaggugaacggcaucagaaagcccaagcaccuguacgugagcaugcccaccgcccagagcaccaugaaggccgaggagaucacccccggcagauucagaaccaucgccugcggccuguuccccgcccaggugaaggccagaaacaucaucagccccgugaugggcgugaucggcuucagcuucuucgugaaggacuggauggagagaaucgaggacuuccuggccgacgagugccccuuccugcccaagcccaagagccccagcgaggccuucauggccaccaacaaggccuacuuccugaacagacagagacaggugaacgacagcaaggugcaggacaucguggaccugaucgaccacgccgagaccgagagcgccacccuguucaccgacaucgccaccccccacagcguguggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccaggcccugaucgacaccaaggugaaggagaucagcaaccaggagccccugaagcuguga

SEQ ID NO: 4917 - RNA, 1287 nt, Artificial Sequence
  derived and/or modified CDS sequence (opt4) from BCCV(BCCV)__AB689163.1__N
augagcaaccugaaggaggugcaggacaacaucaccacccacgagcagcagcugguggccgccagacagaagcugaaggacgccgagagaaccgugggcguggaccccgacgacgugaacaagagcacccugcagaacagaagagccgccgugagcgcccuggaggccaagaucggcgagcugaagagacagcuggccgaccugguggccgcccagaagcuggccaccaagagcguggaccccaccggcaucgagcccgacgaccaccugaaggagaagagcagccugagauacggcaacgugcuggacgugaacagcaucgaccuggaggagcccagcggccagaccgccgacuggaaggccaucggcaccuacauccugagcuucgugcugcccaucgugcugaaggcccuguacaugcugagcaccagaggcagacagaccgugaaggagaacaagggcaccagaaucagauucaaggacgacagcagcuacgaggacgugaacggcaucagaaagcccaagcaccuguacgugagccugcccaccgcccagagcaccaugaaggccgacgagaucacccccggcagauucagaaccaucgugugcggccuguuccccgcccagaucaaggccagaaacaucaucagccccgugaugggcgugaucggcuucagcuucuucgugaaggacuggguggacaagaucgaggacuuccugagagccgagugccccuuccugcccaagcccagagcccaggccgagagcuuccugagcaccaacggcgccuacuucaugaacagacagacccagguggaggagagcaaggugcaggacauccuggaccugaucgacaccgccgagagcggcggcgccacccuguucgacaacaucgccagcccccagagcgccuggaucuucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugaucaacuggggcaaggaggccgugaaccacuuccaccugggcgacgacauggaccccgagcugagacagcuggcccaggcccugguggacaccaaggugaaggagaucagcaaccaggagccccugaagaucuga

SEQ ID NO: 4918 - RNA, 1287 nt, Artificial Sequence
  derived and/or modified CDS sequence (opt4) from BCCV(BCCV)__L39949.1__N
augagcaaccugaaggaggugcaggacaacaucaccacccacgagcagcagcugguggccgccagacagaagcugaaggacgccgagagaaccguggagguggaccccgacgacgugaacaagagcacccugcagaacagaagagccgccgugagcgcccuggaggccaagaucggcgagcugaagagacagcuggccgaccugguggccgcccagaagcuggccaccaagagcguggaccccaccggcaucgagcccgacgaccaccugaaggagaagagcagccugagauacggcaacgugcuggacgugaacagcaucgaccuggaggagcccagcggccagaccgccgacuggaaggccaucggcaccuacauccugagcuucgugcugcccaucgugcugaaggcccuguacaugcugagcaccagaggcagacagaccgugaaggagaacaagggcaccagaaucagauucaaggacgacagcagcuacgaggacgugaacggcaucagaaagcccaagcaccuguacgugagccugcccaccgcccagagcaccaugaaggccgacgagaucacccccggcagauucagaaccaucgugugcggccuguuccccgcccagaucaaggccagaaacaucaucagccccgugaugggcgugaucggcuucagcuucuucgugaaggacuggguggacaagaucgaggacuuccugagagccgagugccccuuccugcccaagcccagagcccaggccgagagcuuccugagcaccaacggcgccuacuucaugaacagacagacccagguggaggagagcaaggugcaggacauccuggaccugaucgacaccgccgagagcggcggcgccacccuguucgacaacaucgccagcccccagagcgccuggaucuucgccugcgcccccgacagaugcccccccaccgcccuguacguggccggcgugcccgagcugggcgccuucuucagcauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugaucaacuggggcaaggaggccgugaaccacuuccaccugggcgacgacauggaccccgagcugagacagcuggcccaggcccugguggacaccaaggugaaggagaucagcaaccaggagccccugaagaucuga

SEQ ID NO: 4919 - RNA, 1290 nt, Artificial Sequence
  derived and/or modified CDS sequence (opt4) from DOBV(DOBV/Ano-Poroia/Afl9/1999)__NC_005233.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4920 - RNA, 1290 nt, Artificial Sequence
  derived and/or modified CDS sequence (opt4) from DOBV(DOB/Saaremaa/160V)__AJ009773.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccugaucagccccgugaugagcgugaucggcuuccugacccuggccaagaacuggaccgagagaguggaggaguggcuggaccugcccugcaagcugcugagcgagcccagccccaccagccugaccaagggccccagcaccaacagagacuaccugagccagagacagggcgcccuggccaagauggagaccaaggaggcccagguggugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugaucgaguggggcaaggaggccguggacagcuuccaccugggcgacgacauggaccccgagaucagaagccuggcccaggcccugaucgaccagaaggugaaggagaucagcaaccaggagccccugaagcuguga

SEQ ID NO: 4921 - RNA, 1290 nt, Artificial Sequence
  derived and/or modified CDS sequence (opt4) from DOBV(Slovakia/400Af/98)__AY168576.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagccugcugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4922 - RNA, 1290 nt, Artificial Sequence
  derived and/or modified CDS sequence (opt4) from DOBV(Slovakia-856-Aa)__AJ269549.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuucauggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgcccccgcccccgacagaugcccccccaccugccuguucaucgccggcauggccgagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4923 - RNA, 1290 nt, Artificial Sequence
  derived and/or modified CDS sequence (opt4) from DOBV(Slovakia-862-Aa)__AJ269550.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuucauggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcagacccgacagaugcccccccaccugccuguucaucgccggcauggccgagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4924 - RNA, 1290 nt, Artificial Sequence
  derived and/or modified CDS sequence (opt4) from DOBV(Esl/29Aa/01)__AY533118.2__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4925 - RNA, 1290 nt, Artificial Sequence
  derived and/or modified CDS sequence (opt4) from DOBV(Kurkino/44Aa/98)__AJ131672.1__N
auggccacccuggaggagcugcagaaggagaucaacagccacgagggccagcuggugaucgccagacagaaggugaaggacgccgagaagcagcacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacaggccgcccuggccaagauggagaccaaggaggcccaggccgugagaaagcacgccaucgacgccggcugcaccaucaucgacuacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaacagagagccccugaagcuguga

SEQ ID NO: 4926 - RNA, 1290 nt, Artificial Sequence
  derived and/or modified CDS sequence (opt4) from DOBV(Kurkino/53Aa/98)__AJ131673.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacaggccgcccuggccaagauggagaccaaggaggcccaggccgugagaaagcacgccaucgacgccggcugcaccaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaacagagagccccugaagcuguga

SEQ ID NO: 4927 - RNA, 1290 nt, Artificial Sequence
  derived and/or modified CDS sequence (opt4) from DOBV(Saar/90Aa/97)__AJ009775.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcagagagagagaccccaccggccuggaccccggcgaccaccugaaggagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccugaucagccccgugaugagcgugaucggcuuccugacccuggccaagaacuggaccgagagaguggaggaguggcuggaccugcccugcaagcugcugagcgagcccagccccaccagccugaccaagggccccagcaccaacagagacuaccugagccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugaucgaguggggcaaggaggccguggacagcuuccaccugggcgacgacauggaccccgagaucagaagccuggcccaggcccugaucgaccagaaggugaaggagaucagcaaccaggagccccugaagcuguga

SEQ ID NO: 4928 - RNA, 1290 nt, Artificial Sequence
  derived and/or modified CDS sequence (opt4) from DOBV(SK/Aa)__AY961615.1__N
auggccacccuggaggagcugcagaaggagaucaacagccacgagggccagcuggugaucgccagacagaaggugaaggacgccgagaagcaguacgagaaggaccccgacgaccugaacaagagaacccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4929 - RNA, 1290 nt, Artificial Sequence
  derived and/or modified CDS sequence (opt4) from DOBV(A35)__GU904030.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuucguggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4930 - RNA, 1290 nt, Artificial Sequence
  derived and/or modified CDS sequence (opt4) from DOBV(3970/87)__L41916.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuucguggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccugccugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4931 - RNA, 1290 nt, Artificial Sequence
  derived and/or modified CDS sequence (opt4) from DOBV(Klyuch-2000)__AF442622.1__N
auggccacccuggaggagcugcagaaggagaucaacagccacgagggccagcuggugaucgccagaagaaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuucgugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucaacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgagcagaaggugaaggagaucagcaaccaggagccccugaagcuguga

SEQ ID NO: 4932 - RNA, 1290 nt, Artificial Sequence
  derived and/or modified CDS sequence (opt4) from DOBV(10636/Ap)__KP878311.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuucgugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaagccuggcccaggcccugaucgaccagaaggugaaggagaucagcaaccaggagccccugaagcuguga

SEQ ID NO: 4933 - RNA, 1290 nt, Artificial Sequence
  derived and/or modified CDS sequence (opt4) from DOBV(10645/Ap)__KP878312.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuucgugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4934 - RNA, 1290 nt, Artificial Sequence
  derived and/or modified CDS sequence (opt4) from DOBV(Aa1854/Lipetsk-02)__EU188452.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacaggccgcccuggccaagauggagaccaaggaggcccaggccgugagaaagcacgccaucgacgccggcugcaccaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagcccgugggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4935 - RNA, 1290 nt, Artificial Sequence
  derived and/or modified CDS sequence (opt4) from DOBV(Ap/Sochi/43)__JF920151.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuucgugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccacagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4936 - RNA, 1290 nt, Artificial Sequence
  derived and/or modified CDS sequence (opt4) from DOBV(Ap/Sochi/hu)__JF920150.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuuccugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccacagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4937 - RNA, 1290 nt, Artificial Sequence
  derived and/or modified CDS sequence (opt4) from DOBV(Ap1584/Sochi-01)__EU188449.1__N
auggccacccuggaggagcugaagaaggagaucaacaaccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuucgugagccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugguggaccacaucgacagccccagcagcaucuggguguucgccggcgcccccgacagaugcccccccaccugccuguucguggccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4938 - RNA, 1290 nt, Artificial Sequence
  derived and/or modified CDS sequence (opt4) from DOBV(DOB/Gola/235Af/07)__KC848495.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcagaaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4939 - RNA, 1290 nt, Artificial Sequence
  derived and/or modified CDS sequence (opt4) from DOBV(DOB/Gola/343Af/07)__KC848498.1__N
auggccacccuggaggagcugcagaaggagaucaacaaccacgagggccagcuggugaucgccagacagaaggugaaggacgccgagaagcaguacgagaaggaccccgacgaccugaacaagagagcccugagcgacagagagagcaucgcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccugaucagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaccgacgccggcugcaaccugaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugaagaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4940 - RNA, 1290 nt, Artificial Sequence
  derived and/or modified CDS sequence (opt4) from DOBV(DOB/Pecs/27Aa/06)__KC848499.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagagugagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4941 - RNA, 1290 nt, Artificial Sequence
  derived and/or modified CDS sequence (opt4) from DOBV(DOB/Pecs/31Aa/06)__KC848500.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggcccagcugggcgccuucuucagcgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaagaugaaggagaucagcaaccaggagccccugaagcuguga

SEQ ID NO: 4942 - RNA, 1290 nt, Artificial Sequence
  derived and/or modified CDS sequence (opt4) from DOBV(DOB/Sarmellek/77Aa/06)__KC848501.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagagcaagaucgacgagcugagaagacagcuggccgacagaguggccagcggcaagaacaucggcaaggagagagaccccaccggccuggaccccggcgaccaccugaccgagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucagcgugcugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaagccuggcccaggcccugaucgaccagaaggugaaggagaucagcaaccaggagccccugaagcuguga

SEQ ID NO: 4943 - RNA, 1290 nt, Artificial Sequence
  derived and/or modified CDS sequence (opt4) from DOBV(GER/05/239/Aa)__GQ205405.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugcugagcgagcccagccccaccagccugaccaagggccccagcaccaacagagacuaccugagccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaagccuggcccaggcccugaucgaccagaaggugaaggagaucagcaaccaggagccccugaagcuguga

SEQ ID NO: 4944 - RNA, 1290 nt, Artificial Sequence
  derived and/or modified CDS sequence (opt4) from DOBV(GER/05/477/Af)__GQ205406.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggaguggcuggaccugcccugcaagcugaucagcgagcccagccccaccagccugaccaagggccccagcaccaacagagacuaccugagccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaagccuggcccaggcccugaucgaccagaaggugaaggagaucagcaaccaggagccccugaagcuguga

SEQ ID NO: 4945 - RNA, 1290 nt, Artificial Sequence
  derived and/or modified CDS sequence (opt4) from DOBV(GER/07/293/Aa)__GQ205401.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggacuggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcugcugaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4946 - RNA, 1290 nt, Artificial Sequence
  derived and/or modified CDS sequence (opt4) from DOBV(GER/07/424/Aa)__GQ205403.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggacuggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4947 - RNA, 1290 nt, Artificial Sequence
  derived and/or modified CDS sequence (opt4) from DOBV(GER/08/118/Aa)__GQ205407.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccaucugcggccuguaccccgcccaggugaaggccagaaaccuggugagccccgugaugagcgugaucggcuuccuggcccuggccaagaacuggaccgagagaguggaggacuggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccgugggcaccagcgaggagaagaugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4948 - RNA, 1290 nt, Artificial Sequence
  derived and/or modified CDS sequence (opt4) from DOBV(GER/08/131/Af)__GQ205408.1__N
auggccacccuggaggagcugcagaaggagaucaacagccacgagggccagcuggugaucgccagacagaaggugaaggacgccgagaagcaguacgagaaggaccccgacgaccugaacaagagagcccugagcgacagagagagcguggcccagagcauccagggcaagaucgacgagcugagaagacagcuggccgacagaguggccgccggcaagaacaucggcaaggagagagaccccaccggccuggaccccggcgaccaccugaaggagaagagcaugcugagcuacggcaacgugaucgaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgacgagaucacccccggcagauucagaaccgccgugugcggccuguaccccgcccaggugaaggccagaaaccuggugagccccgugaugagcgugaucggcuuccuggcccuggccaagaacuggaccgagagaguggaggacuggcuggaccugcccugcaagcugcugagcgagcccagccccaccagccugaccaagggccccagcaccaacagagacuaccugaaccagagacagggcgcccuggccaagauggagaccaaggaggcccaggccgugagaaagcacgccaucgacgccggcugcaacaucaucgaccacaucgacagccccagcagcaucuggguguucgccggcgcccccgacagaugcccccccaccugccuguucaucgccggcauggccgagcugggcgccuucuucgccgugcugcaggacaugagaaacaccaucauggccagcaagaccaucggcaccagcgaggagaagcugagaaagaagagcagcuucuaccagagcuaccugagaagaacccagagcaugggcauccagcuggaccagagaaucaucgugcuguucaugguggacuggggcaaggaggccguggacagcuuccaccugggcgacgacauggaccccgagcugagaggccuggcccaggcccugaucgaccagaaggugaaggagaucagcaaccaggagccccugaagcuguga

SEQ ID NO: 4949 - RNA, 1290 nt, Artificial Sequence
  derived and/or modified CDS sequence (opt4) from HTNV(76-118/POR)__KT885049.1__N
auggccaccauggaggagcugcagagagagaucaacgcccacgagggccagcuggugaucgccagacagaaggugagagacgccgagaagcaguacgagaaggaccccgacgagcugaacaagagagcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4950 - RNA, 1290 nt, Artificial Sequence
  derived and/or modified CDS sequence (opt4) from HTNV(A16)__AF288646.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggccuggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccaacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgugcugagaacccuggcccagagccugaucgacgugaaggugaaggagaucagcaaccaggagccccugaagcuguga

SEQ ID NO: 4951 - RNA, 1290 nt, Artificial Sequence
  derived and/or modified CDS sequence (opt4) from HTNV(CA09082007)__HQ834499.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuacaucagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgaccugaaggugaaggagaucagcaaccaggagccccugaagcuguga

SEQ ID NO: 4952 - RNA, 1290 nt, Artificial Sequence
  derived and/or modified CDS sequence (opt4) from HTNV(CA10081109)__HQ834500.1__N
augcccaccagcggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcgagcuguaccccgcccagaucaaggccagcaagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacccccacgccggcgacgacguggaccccagccugggcaugcuggcccagagccugaucgacgugaaggugaaggagaucagcaaccaggagccccugaagcuguga

SEQ ID NO: 4953 - RNA, 1290 nt, Artificial Sequence
  derived and/or modified CDS sequence (opt4) from HTNV(CA10081113)__HQ834501.1__N
auggccaccagcggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucuucgagcuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacagacaccugaugaacaucguggaccccgagcccagagcccuggcccagagccugaucgacgugaaggugaaggagaucagcaaccaggagccccugaagcuguga

SEQ ID NO: 4954 - RNA, 1290 nt, Artificial Sequence
  derived and/or modified CDS sequence (opt4) from HTNV(CA10081203)__HQ834502.1__N
auggccaccaacggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucuucggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacgagcugcacagcggcgacggcgagcaccacgccagcagaacccuggcccagagccugaucgacgugaaggugaaggagaucagcaaccaggagccccugaagcuguga

SEQ ID NO: 4955 - RNA, 1290 nt, Artificial Sequence
  derived and/or modified CDS sequence (opt4) from HTNV(CA10081206)__HQ834503.1__N
auggccaccaucgaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccacgccugggacggcauggaccccgagcugagaacccuggcccagagccugaucgacgugaaggugaaggagaucagcaaccaggagccccugaagcuguga

SEQ ID NO: 4956 - RNA, 1290 nt, Artificial Sequence
  derived and/or modified CDS sequence (opt4) from HTNV(CA10081708)__HQ834504.1__N
augcccaccagcggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucuucgagcuguaccccgcccagaucaaggccagaaagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacccccacaccggcgacgacgccgaccccgagcugagaacccuggcccagagccugaucgacgugaaggugaaggagaucagcaaccaggagccccugaagcuguga

SEQ ID NO: 4957 - RNA, 1290 nt, Artificial Sequence
  derived and/or modified CDS sequence (opt4) from HTNV(CA10081905)__HQ834505.1__N
auggccaccagcggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucuucgagcuguaccccgcccagaucaaggccagaaagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaaccaccaccugaucaacgccggcgaccacgagcugagaacccuggcccagagccugaucgacgugaaggugaaggagaucagcaaccaggagccccugaagcuguga

SEQ ID NO: 4958 - RNA, 1290 nt, Artificial Sequence
  derived and/or modified CDS sequence (opt4) from HTNV(E142)__AF288644.1__N
auggccaccauggaggagcugcagagagagaucaacgcccacgagggccagcuggugaucgccagacagaaggugagagacgccgagaagagauacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcagcgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggugguggacaacuuccaccugggcgacgacauggaccccgagcugagaacccuggcccagagccugaucgacgugaaggugaaggagaucagcaaccaggagccccugaagcuguga

SEQ ID NO: 4959 - RNA, 1290 nt, Artificial Sequence
  derived and/or modified CDS sequence (opt4) from HTNV(H10150)__HQ834506.1__N
auggccaccaugggcgagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucuucggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaaccaccacugggccaacgccaucggcagcgagcugagaacccuggcccagagccugaucgacgugaaggugaaggagaucagcaaccaggagccccugaagcuguga

SEQ ID NO: 4960 - RNA, 1290 nt, Artificial Sequence
  derived and/or modified CDS sequence (opt4) from HTNV(Aa03-161)__KT935024.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacgccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4961 - RNA, 1290 nt, Artificial Sequence
  derived and/or modified CDS sequence (opt4) from HTNV(Aa04-722)__KU207190.1__N
auggccaccauggaggagcugcagagagagaucaacgcccacgagggccagcuggugaucgccagacagaaggugagagacgccgagagacaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4962 - RNA, 1290 nt, Artificial Sequence
  derived and/or modified CDS sequence (opt4) from HTNV(Aa05-190)__KT935027.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4963 - RNA, 1290 nt, Artificial Sequence
  derived and/or modified CDS sequence (opt4) from HTNV(Aa10-123)__KT935036.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccaccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucguggccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4964 - RNA, 1290 nt, Artificial Sequence
  derived and/or modified CDS sequence (opt4) from HTNV(Aa10-265)__KU207194.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucguggccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4965 - RNA, 1290 nt, Artificial Sequence
  derived and/or modified CDS sequence (opt4) from HTNV(AA1028)__AF427318.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4966 - RNA, 1290 nt, Artificial Sequence
  derived and/or modified CDS sequence (opt4) from HTNV(Aa10-434)__KT935038.1__N
auggccaccauggaggagcugcagagagagaucaacgcccacgagggccagcuggugaucgccagacagaaggugagagacgccgagaagcaguacggcaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4967 - RNA, 1290 nt, Artificial Sequence
  derived and/or modified CDS sequence (opt4) from HTNV(Aa14-362)__KT935049.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaguggagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4968 - RNA, 1290 nt, Artificial Sequence
  derived and/or modified CDS sequence (opt4) from HTNV(Aa14-404)__KT935052.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcagccaggagccccugaagcuguga

SEQ ID NO: 4969 - RNA, 1290 nt, Artificial Sequence
  derived and/or modified CDS sequence (opt4) from HTNV(Aa15-56)__KU207195.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaacgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4970 - RNA, 1290 nt, Artificial Sequence
  derived and/or modified CDS sequence (opt4) from HTNV(AA1719)__AF427319.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaucaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4971 - RNA, 1290 nt, Artificial Sequence
  derived and/or modified CDS sequence (opt4) from HTNV(AP1168)__AF427323.1__N
auggccaccauggaggagcugcagaaggagaucaacgcccacgagggccagcuggugaucgccagacagaaggugagagacgccgagagacaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagauggugagccccgugaugagcgugaucggcuuccuggcccuggccaaggacuggggcgacagaaucgagcaguggcugagcgagcccugcaagcugcugcccgacaccgccgccgugagccugcacggcggccccgccaccaacagagacuaccugagacagagacaggccgcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgaccugaaggugaaggagaucagcaaccaggagccccugaagcuguga

SEQ ID NO: 4972 - RNA, 1290 nt, Artificial Sequence
  derived and/or modified CDS sequence (opt4) from HTNV(AP708)__AF427322.1__N
auggccaccauggaggagcugcagaaggagaucaacgcccacgagggccagcuggugaucgccagacagaaggugagagacgccgagagacaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagauggugagccccgugaugagcgugaucggcuuccuggcccuggccaaggacuggggcgacagaaucgagcaguggcugagcgagcccugcaagcugcugcccgacaccgccgccgugagccugcacggcggccccgccaccaacagagacuaccugagacagagacaggccgcccugggcaacauggagaccaaggagagcaaggccaucagacagcacgccgagaccgccggcugcagcaugaucgaggacaucgagagccccagcagcguguggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgaccugaaggugaaggagaucagcaaccaggagccccugaagcuguga

SEQ ID NO: 4973 - RNA, 1290 nt, Artificial Sequence
  derived and/or modified CDS sequence (opt4) from HTNV(DandongHu-32)__KC570386.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaauccuggcccagagccugaucgacgugaaggugaaggagaucagcaaccaggagccccugaagcuguga

SEQ ID NO: 4974 - RNA, 1290 nt, Artificial Sequence
  derived and/or modified CDS sequence (opt4) from HTNV(DandongHu-34)__KC570387.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcauggccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4975 - RNA, 1290 nt, Artificial Sequence
  derived and/or modified CDS sequence (opt4) from HTNV(DandongHu-89)__KC570389.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccugugcgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4976 - RNA, 1290 nt, Artificial Sequence
  derived and/or modified CDS sequence (opt4) from HTNV(DandongHu-91)__KC570390.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugggcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcauggccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4977 - RNA, 1290 nt, Artificial Sequence
  derived and/or modified CDS sequence (opt4) from HTNV(Fuyuan-Aa-145)__KJ857349.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccugcaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4978 - RNA, 1290 nt, Artificial Sequence
  derived and/or modified CDS sequence (opt4) from HTNV(Fuyuan-Aa-26)__KJ857347.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucgccgugcccauccugcugaaggcccuguacaugcugaccaccagaggcagacagaccaccaaggacaacaagggcaccagaaucagauucaaggacgacagcagccuggaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccccuucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4979 - RNA, 1290 nt, Artificial Sequence
  derived and/or modified CDS sequence (opt4) from HTNV(JS1)__KP970572.1__N
auggccaccauggaggagcugcagagagagaucaacgcccacgagggccagcuggugaucgccagacagaaggugagagacgccgagaagcaguacgagaacgaccccgacgagcugaacaagagagcccugaccaacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4980 - RNA, 1290 nt, Artificial Sequence
  derived and/or modified CDS sequence (opt4) from HTNV(LongquanAa-08-150)__JQ912697.1__N
auggccaccauggaggagcugcagagagagaucgacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4981 - RNA, 1290 nt, Artificial Sequence
  derived and/or modified CDS sequence (opt4) from HTNV(LongquanAa-08-157)__JQ912698.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4982 - RNA, 1290 nt, Artificial Sequence
  derived and/or modified CDS sequence (opt4) from HTNV(LongquanAa-08-314)__JQ912709.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcaugcaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4983 - RNA, 1290 nt, Artificial Sequence
  derived and/or modified CDS sequence (opt4) from HTNV(LongquanAa-08-573)__JQ912714.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgccaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4984 - RNA, 1290 nt, Artificial Sequence
  derived and/or modified CDS sequence (opt4) from HTNV(LongquanAa-09-113)__JQ912716.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaccagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4985 - RNA, 1290 nt, Artificial Sequence
  derived and/or modified CDS sequence (opt4) from HTNV(LongquanAa-09-191)__JQ912719.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaucaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4986 - RNA, 1290 nt, Artificial Sequence
  derived and/or modified CDS sequence (opt4) from HTNV(LongquanAa-09-192)__JQ912720.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcaugcagggcaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4987 - RNA, 1290 nt, Artificial Sequence
  derived and/or modified CDS sequence (opt4) from HTNV(LongquanAa-10-46)__JQ912754.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccgagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4988 - RNA, 1290 nt, Artificial Sequence
  derived and/or modified CDS sequence (opt4) from HTNV(LongquanAa-11-745)__KC344237.1__N
auggccaccauggaggagcugcagaaggagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacugggccgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4989 - RNA, 1290 nt, Artificial Sequence
  derived and/or modified CDS sequence (opt4) from HTNV(ROKA14-11)__KU207207.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucguggccggcaucgccgagcugggcgccuucuucagcauccugcaggacaugagaaacaccaucauggccagcaagaccgugggcaccagcgaggagaagaugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4990 - RNA, 1290 nt, Artificial Sequence
  derived and/or modified CDS sequence (opt4) from HTNV(US8A14-2)__KU207208.1__N
auggccaccauggaggagcugcagagagagaucaacgcccacgagggccagcuggugaucgccagacagaaggugagagacgccgagaagcaggacggcaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4991 - RNA, 1290 nt, Artificial Sequence
  derived and/or modified CDS sequence (opt4) from HTNV(US8A15-1)__KU207209.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaucgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4992 - RNA, 1290 nt, Artificial Sequence
  derived and/or modified CDS sequence (opt4) from HTNV(YaluRiver13)__HQ611981.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcggccagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccagcaucggcgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucauggugagcuggggcaaggaggccguggacaacuuccaccugggcgacgacauggaccccgagcugagaacccuggcccagagccugaucgacgugaaggugaaggagauccccaaccaggagccccugaagcuguga

SEQ ID NO: 4993 - RNA, 1290 nt, Artificial Sequence
  derived and/or modified CDS sequence (opt4) from HTNV(84FLi)__AY017064.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaacuaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4994 - RNA, 1290 nt, Artificial Sequence
  derived and/or modified CDS sequence (opt4) from HTNV(Bao14)__AB127998.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4995 - RNA, 1290 nt, Artificial Sequence
  derived and/or modified CDS sequence (opt4) from HTNV(Chen4)__AB027101.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgcccccugcaagcugcugcccgacaccgccgccgugagccugcacggcggccccgccaccaacagagacaaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuucagacugggcgacgacauggaccccgagcugagaacccuggcccagagccugaucgacgugaaggugaaggagaucagcaaccaggagccccugaagcuguga

SEQ ID NO: 4996 - RNA, 1290 nt, Artificial Sequence
  derived and/or modified CDS sequence (opt4) from HTNV(Hu)__AB027111.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaagcccccccaccugcauguucaucgccggcaucgacgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacaucaaggugaaggagaucagcaaccaggagccccugaagcuguga

SEQ ID NO: 4997 - RNA, 1290 nt, Artificial Sequence
  derived and/or modified CDS sequence (opt4) from HTNV(HubeiHu02)__JQ665905.1__N
auggccaccauggaggagcugcagaaggagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggacaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4998 - RNA, 1290 nt, Artificial Sequence
  derived and/or modified CDS sequence (opt4) from HTNV(HV004)__JQ083395.1__N
auggccaccauggaggagcugcagaaggagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 4999 - RNA, 1290 nt, Artificial Sequence
  derived and/or modified CDS sequence (opt4) from HTNV(Maaji-1)__AF321094.1__N
auggccaccauggaggagcugcagaaggagaucaacgcccacgagggccagcuggugaucgccagacagaaggugagagacgccgagagacaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuucauggcccuggccaaggacuggagcgagagaaucgagcaguggcugagcgagcccugcaagcugcugcccgacaccagcgccgugagccugcugggcggccccgccaccaacaaggacuaccugagacagagacagguggcccugggcaacauggagaccaaggagagcaaggccaucagacagcaggccgaggccagcggcugcagcaugaucgaggacaucgagagccccagcagcaucuggguguucgccggcgcccccgacagaugcccccccaccugccuguucaucgccggcauggccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5000 - RNA, 1290 nt, Artificial Sequence
  derived and/or modified CDS sequence (opt4) from HTNV(Maaji-2)__AF321095.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaacuucggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagcugaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5001 - RNA, 1290 nt, Artificial Sequence
  derived and/or modified CDS sequence (opt4) from HTNV(N8)__DQ658415.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguaccugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacgccgccgccgugagccugcacggcggccccgccaccaacagagacuaccugagacagagacagguggcccugggcaacauggagaccaaggagagcaaggccaucagacagcacgccgagaccgccggcugcagcaugaucgacgacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5002 - RNA, 1290 nt, Artificial Sequence
  derived and/or modified CDS sequence (opt4) from HTNV(Q32)__AB027097.1__N
auggccaccauggaggagcugcagagagagaucaacgcccacgagggccagcuggugaucgccagacugaaggugagagacgccgagaagcccuacgagaaggaccccgacgagcugaacaugagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccagcccggcgacgacauggaccccgagcugagaacccuggcccagagccugaucgacgugaaggugaaggagaucagcaaccaggagccccugaagcuguga

SEQ ID NO: 5003 - RNA, 1290 nt, Artificial Sequence
  derived and/or modified CDS sequence (opt4) from HTNV(SXHu2012B1)__KC844226.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5004 - RNA, 1290 nt, Artificial Sequence
  derived and/or modified CDS sequence (opt4) from HTNV(TJJ16)__AY839871.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggccuggccgccagcauccaggccaagaucgacgagcugaagagacagcuggccgacagaaucgccaccggcaagaaccugggcaaggagagagaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguacaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5005 - RNA, 1290 nt, Artificial Sequence
  derived and/or modified CDS sequence (opt4) from HTNV(WCL)__KM355414.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcuggagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5006 - RNA, 1290 nt, Artificial Sequence
  derived and/or modified CDS sequence (opt4) from HTNV(YN509)__GU329991.1__N
auggccaccauggaggagcugcagaaggagaucaacgcccacgagggccagcugaucaucgccaagcagaaggugaaggacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggccaggacagagaccccaccggcguggagcccggcgaccaccugaaggagagaagcaugcugagcuacggcaacauccuggaccugaaccaccuggacaucgacgagcccaccggccagaccgccgacuggcugagcaucaucguguaccugaccagcuucguggugcccauccugcugaaggcccuguacaugcugaccaccagaggcagacagaccgccaaggacaacaagggcaccagaaucagauucaaggacgacagcagcuucgaggacgugaacggcaucagaaagcccaagcaccuguacgugagcaugcccaacgcccagagcagcaugaaggccgaggagaucacccccggcagauacagaaccgccgugugcggccuguaccccgcccagaucaaggccagacagauggugagccccgugaugagcgugaucggcuucauggcccuggccaaggacuggaccgacagaaucgagaacuggcugggcgagcccugcaagcugcugcccgacaccagcagcgugauccugcugggcggccccgccaccaacagagacuacaucagacagagacagguggcccugggcaacauggagaccaaggaggccaaggccgugagacagcacgccgagagcgccggcugcagcaugaucgacaacaucgacagccccagcagcaucuggguguucgccggcgcccccgacagaugcccccccaccugccuguucguggccggccuggccgagcugggcgccuucuucagcauccugcaggacaugagaaacaccaucauggccagcaagaccgugggcaccagcgaggagaagaugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaaaccuggcccagagccugaucgaccagaaggugaaggagaucagcaaccaggagccccugaagcuguga

SEQ ID NO: 5007 - RNA, 1290 nt, Artificial Sequence
  derived and/or modified CDS sequence (opt4) from HTNV(YU62)__AY748309.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggccuggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5008 - RNA, 1290 nt, Artificial Sequence
  derived and/or modified CDS sequence (opt4) from HTNV(ZLS6-11)__FJ753396.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacaucaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5009 - RNA, 1290 nt, Artificial Sequence
  derived and/or modified CDS sequence (opt4) from HTNV__AB027523.1__N
auggccaccauggaggagcugcagaaggagaucaacgcccacgagggccagcugaucaucgccaagcagaaggugaaggacgccgagaagcaguacgagaaggaccccgacgagcugaacaagagagcccugaccgacagagagggcgugagcgccagcauccaggccaagaucgacgagcugaagagacagcuggccgacagaaucgccaccggcaagaaccugggccaggacagagaccccaccggcguggagcccggcgaccaccugaaggagagaagcaugcugagcuacggcaacauccuggaccugaaccaccuggacaucgacgagcccaccggccagaccgccgacuggcugagcaucaucguguaccugaccagcuucguggugcccauccugcugaaggcccuguacaugcugaccaccagaggcagacagaccgccaaggacaacaagggcaccagaaucagauucaaggacgacagcagcuucgaggacgugaacggcaucagaaagcccaagcaccuguacgugagcaugcccaacgcccagagcagcaugaaggccgaggagaucacccccggcggcuacagaaccgccgugugcggccuguuccccgcccagaucaaggccagacagauggugagccccgugaugagcgugaucggcuucauggcccuggccaaggacuggaccgacagaaucgagagcuggcugggcgagcccugcaagcugcugcccgacaccagcgccgugagccugcugggcggccccgccaccaacagagacuacaucagacagagacagguggcccugggcaacauggagaccaaggaggccaaggccgugagacagcacgccgagagcgccggcugcagcaugaucgacaacaucgacagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagaugagaaagaagagcagcuucuaccagagcuaccugagaagaacccagagcaugggcauccagcuggaccagagaaucaucgugcuguucaugguggccuggggcaaggaggccgccgacaacuuccagcacggcgacgacauggaccccgagcugagaacccuggcccagagccugaucgaccagaaggugaaggagaucagcaaccaggagccccugaagcuguga

SEQ ID NO: 5010 - RNA, 1293 nt, Artificial Sequence
  derived and/or modified CDS sequence (opt4) from HTNV__D25530.1__N
augauggccaccauggaggagcugcagagagagaucaacgcccacgagggccagcuggugaucgccagacagaaggugagagacgccgagaagcaguacgagaaggaccccgacgagcugaacaagagagcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5011 - RNA, 1290 nt, Artificial Sequence
  derived and/or modified CDS sequence (opt4) from HTNV__M14626.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcugggccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5012 - RNA, 1290 nt, Artificial Sequence
  derived and/or modified CDS sequence (opt4) from HTNV__X95077.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccacccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccaccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5013 - RNA, 1290 nt, Artificial Sequence
  derived and/or modified CDS sequence (opt4) from HTNV(CGAa1011)__EF990913.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuggacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugggcgagcccugcaagcugcugcccgacaccgccgccgugagccugcugggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcgugcugcaggacaugagaaacaccaucauggccagcaagaccgugggcaccagcgaggagaagcugagaaagaagagcagcuucuaccagagcuaccugggcagaacccagagcaugggcauccagcuggaccagagaaucaucgugcuguucaugguggccuggggcaaggaggccguggacaacuuccaccugggcgacgacguggaccccgagcugagaacccuggcccagagccugaucgacgugaaggugaaggagaucagcgaccaggagccccugaagcuguga

SEQ ID NO: 5014 - RNA, 1290 nt, Artificial Sequence
  derived and/or modified CDS sequence (opt4) from HTNV(CGAa1015)__EF990912.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuggacgugagccugcccaacgcccagagcagcaugaaggccgaggagaucacccccggcagauacagaaccgccaucugcggccuguaccccgcccagaucaaggccagacagaugaucagccccgugaugagcgugaucggcuaccuggcccuggccaaggacuggagcgacagaaucgagcaguggcugggcgagcccugcaagcugcugcccgacaccgccgccgugagccugcugggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucaucagcgugcugcaggacaugagaaacaccaucauggccagcaagaccgugggcaccagcgaggagaagcugagaaagaagagcagcuucuaccagagcuaccugggcagaacccagagcaugggcauccagcuggaccagagaaucaucgugcuguucaugguggccuggggcaaggaggccguggacaacuuccaccugggcgacgacguggaccccgagcugagaacccuggcccagagccugaucgacgugaaggugaaggagaucagcgaccaggagccccugaagcuguga

SEQ ID NO: 5015 - RNA, 1290 nt, Artificial Sequence
  derived and/or modified CDS sequence (opt4) from HTNV(CGAa2)__EU092219.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccaaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagcccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5016 - RNA, 1290 nt, Artificial Sequence
  derived and/or modified CDS sequence (opt4) from HTNV(CGAa31MP7)__EF990911.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5017 - RNA, 1290 nt, Artificial Sequence
  derived and/or modified CDS sequence (opt4) from HTNV(CGAa31P9)__EF990910.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccgagaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5018 - RNA, 1290 nt, Artificial Sequence
  derived and/or modified CDS sequence (opt4) from HTNV(CGAa4MP9)__EF990915.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugggcgagcccugcaagcugcugcccgacaccgccgccgugagccugcugggcggccccgccaccaacagagacuaccugagacagagacagguggcccugggcaacauggagaccaaggagagcaaggccaucagacagcacgccgagaccgccggcugcagcaugaucgaggacaucgagagccccagcagcaucuggguguucgccggcgcccccgacagaugcccccccaccugccuguucaucgccggcaucgccgagcugggcgccuucuucagcgugcugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5019 - RNA, 1290 nt, Artificial Sequence
  derived and/or modified CDS sequence (opt4) from HTNV(CGAa75)__EU092220.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcagcguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugaacgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5020 - RNA, 1290 nt, Artificial Sequence
  derived and/or modified CDS sequence (opt4) from HTNV(CGHu1)__EU092218.1__N
auggccaccauggaggagcugcagagagagaucaacgcccacgagggccagcuggugaucgccagacagaaggugagagacgccgagaagcaguacgagaaggacagcgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagccugguggugcccauccugcugaaggcccuguacaugcugaccaccaagggcagacagaccaccaaggacaacaagggcaccagaaucagauucaaggacgacagcagcuucgaggacgugaacggcaucagaaagcccaagcaccuguacgugagccugcugaacgcccagagcagcaugaaggccgaggagaucacccccggcagauacagaaccgccaucugcggccccuaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucugggugagcgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5021 - RNA, 1290 nt, Artificial Sequence
  derived and/or modified CDS sequence (opt4) from HTNV(CGHu2)__EU363813.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagccugguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcaucagccaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5022 - RNA, 1290 nt, Artificial Sequence
  derived and/or modified CDS sequence (opt4) from HTNV(CGHu3612)__EF990909.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggccuggccgccagcauccaggccaagaucgacgagcugaagagacagcuggccgacagaguggccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugagagagaucagcaaccaggagccccugaagcuguga

SEQ ID NO: 5023 - RNA, 1290 nt, Artificial Sequence
  derived and/or modified CDS sequence (opt4) from HTNV(CGRn15)__EU363810.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugacccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5024 - RNA, 1290 nt, Artificial Sequence
  derived and/or modified CDS sequence (opt4) from HTNV(CGRn2616)__EU363811.1__N
auggccaccauggaggagcugcagagagagaucaacgcccacgagggccagcuggugaucgccagacagaaggugagagacgccggcaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucggcagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacguggaggugaaggagaucagcaaccaggagccccugaagcuguga

SEQ ID NO: 5025 - RNA, 1290 nt, Artificial Sequence
  derived and/or modified CDS sequence (opt4) from HTNV(CGRn53)__EF990907.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5026 - RNA, 1290 nt, Artificial Sequence
  derived and/or modified CDS sequence (opt4) from HTNV(CGRn5310)__EF990906.1__N
auggccaccauggaggagcugcagagagagaucaacgcccacgagggccagcuggugaucgccagacagaaggugagagacgccgagaagcaguacgagaaggaccccgacgagcccaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5027 - RNA, 1290 nt, Artificial Sequence
  derived and/or modified CDS sequence (opt4) from HTNV(CGRn93MP8)__EF990905.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgcccccauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcagcagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5028 - RNA, 1290 nt, Artificial Sequence
  derived and/or modified CDS sequence (opt4) from HTNV(CGRn93P8)__EF990904.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucaucagcauccugcaggacaugagaaacaccaucauggccagcaagaccgugggcaccagcgaggagaagcugagaaacaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5029 - RNA, 1290 nt, Artificial Sequence
  derived and/or modified CDS sequence (opt4) from HTNV(CGRni1)__EU363812.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcagagagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacaucaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugguggaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcugcugaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5030 - RNA, 1290 nt, Artificial Sequence
  derived and/or modified CDS sequence (opt4) from HTNV(CJAp93)__EF208929.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugggccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccgugaacaacuuccaccugggcgacgacauggaccccgagcugagaacccuggcccagagccugaucgacgugaaggugaaggagaucagcaaccaggagccccugaagcuguga

SEQ ID NO: 5031 - RNA, 1290 nt, Artificial Sequence
  derived and/or modified CDS sequence (opt4) from HTNV(Aa14_207)__KX687234.1__N
auggccaccauggaggagcugcagagagagaucaacgcccacgagggccagcuggugaucgccagacagaaggugagagacgccgagaagcaguacggcaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucguggccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5032 - RNA, 1290 nt, Artificial Sequence
  derived and/or modified CDS sequence (opt4) from HTNV(Aa14_234)__KX687235.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugggcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5033 - RNA, 1290 nt, Artificial Sequence
  derived and/or modified CDS sequence (opt4) from HTNV(Aa14_239)__KX687236.1__N
auggccaccauggaggagcugcagagagagaucaacgcccacgagggccagcuggugaucgccagacagaaggugagagacgccgagaagcaggacggcaaggaccccgacgagcugaacaagagagcccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugggcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5034 - RNA, 1290 nt, Artificial Sequence
  derived and/or modified CDS sequence (opt4) from HTNV(AY133/2011)__KY807166.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaacaucggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugagcggcaucagaaagcccaagcaccuguaccugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgacgacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5035 - RNA, 1290 nt, Artificial Sequence
  derived and/or modified CDS sequence (opt4) from HTNV(GAN13/2011)__KY807168.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguaccugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagaccgccggcugcagcaugaucgacgacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5036 - RNA, 1290 nt, Artificial Sequence
  derived and/or modified CDS sequence (opt4) from HTNV(GAN19/2011)__KY807172.1__N
auggccaccauggaggagcugcagagagagaucaacgcccacgagggccagcuggugaucgccagacagaaggugagagacgccgagaagcaguacgagaaggaccccgacgagcugaacaagagagcccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguaccugagccugcccaacgcccagagcagcaugaaggccgaggagaucacccccggcagauacagaaccgccaucugcggccuguaccccgcccagaucaaggccagacagaugaccagccccgugaugagcgugaucggcuuccuggcccuggccaaggacuggagcgacagaaucgagcaguggcugagcgagcccugcaagcugcugcccgacaccgccgccgugagccugcacggcggccccgccaccagcagagacuaccugagacagagacagguggcccugggcaacauggagaccaaggagagcaaggccaucagacagcacgccgagaccgccggcugcagcaugaucgacgacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagccuguaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5037 - RNA, 1290 nt, Artificial Sequence
  derived and/or modified CDS sequence (opt4) from HTNV(LR1)__AF288294.1__N
auggccaccauggaggagcugcagagagagaucaacgcccacgagggccagcuggugaucgccagacagaaggugagagacgccgagaagcaguacgagaaggaccccgacgagcugaacaagagagcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccgacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5038 - RNA, 1290 nt, Artificial Sequence
  derived and/or modified CDS sequence (opt4) from HTNV(RG9)__AF288296.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucaccgccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5039 - RNA, 1290 nt, Artificial Sequence
  derived and/or modified CDS sequence (opt4) from HTNV(S85-46)__AF288659.1__N
auggccaccauggaggagcugcagagagagaucaacgcccacgagggccagcuggugaucgccagacagaaggugagagacgccgagaagcaguacgagaaggaccccgacgagcugaacaagagcgcccugaccaacagagagggcguggccgugagcauccaggccaagaucgacgagcugaagaugcagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucaucguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugaucgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccggcagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5040 - RNA, 1290 nt, Artificial Sequence
  derived and/or modified CDS sequence (opt4) from HTNV(SN7)__AF288657.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaagaccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5041 - RNA, 1290 nt, Artificial Sequence
  derived and/or modified CDS sequence (opt4) from HTNV(84FLi)__AF366568.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgccagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccaucugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcacggcggccccgccaccaacagagacuaccugagacagagacagguggcccugggcaacauggagaccaaggagagcaaggccaucagacagcacgccgagagcgccggcugcagcaugaucgaggacaucgagagccccagcagcaucuggguguucgccggcgcccccaacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5042 - RNA, 1290 nt, Artificial Sequence
  derived and/or modified CDS sequence (opt4) from HTNV(KHF,clone:4)__LC209206.1__N
auggccaccauggaggagcugcagagagagaucaacgcccacgagggccagcuggugaucgccagacagaaggugagagacgccgagaagcaguacgagaaggaccccgacgagcugaacaagagaacccugaccgacagagagggcguggccgugagcauccaggccaagaucgacgagcugaagagacagcuggccgacagaaucgccaccggcaagaaccugggcaaggagcaggaccccaccggcguggagcccggcgaccaccugaaggagagaagcaugcugagcuacggcaacgugcuggaccugaaccaccuggacaucgacgagcccaccggccagaccgccgacuggcugagcaucgugguguaccugaccagcuucguggugcccauccugcugaaggcccuguacaugcugaccaccagaggcagacagaccaccaaggacaacaagggcaccagaaucagauucaaggacgacagcagcuucgaggacgugaacggcaucagaaagcccaagcaccuguacgugagccugcccaacgcccagagcagcaugaaggccgaggagaucacccccggcagauacagaaccgccgugugcggccuguaccccgcccagaucaaggccagacagaugaucagccccgugaugagcgugaucggcuuccuggcccuggccaaggacuggagcgacagaaucgagcaguggcugagcgagcccugcaagcugcugcccgacaccgccgccgugagccugcugggcggccccgccaccaacagagacuaccugagacagagacagguggcccugggcaacauggagaccaaggagagcaaggccaucagacagcacgccgaggccgccggcugcagcaugaucgaggacaucgagagccccagcagcaucuggguguucgccggcgcccccgacagaugcccccccaccugccuguucaucgccggcaucgccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucgugcuguucaugguggccuggggcaaggaggccguggacaacuuccaccugggcgacgacauggaccccgagcugagaacccuggcccagagccugaucgacgugaaggugaaggagaucagcaaccaggagccccugaagcuguga

SEQ ID NO: 5043 - RNA, 1287 nt, Artificial Sequence
  derived and/or modified CDS sequence (opt4) from LANV(510B)__AF005727.1__N
augagcaaccugcaggaggugcaggagggcaucacccugcacgagcagcagcugguggccgccagacagaagcugaaggacgccgagaaggccguggagguggaccccgacgacgugaacaagagcacccugcagagcagaagagccgccgugagcgcccuggagaacaagcuggccgagcugaagagacagcuggccgaccugguggccgcccagaagcuggccgccaagcccguggaccccaccggccuggagcccgacgaccaccugaaggagaagagcgcccugagauacggcaacgugcuggacgugaacgccaucgaccuggaggagcccagcggccagaccgccgacuggaaggccaucggcgccuacauccugggcuucgugauccccaucauccugaaggcccuguacaugcugagcaccagaggcagacagaccgugaaggagaacaagggcaccagaaucagauucaaggacgacagcagcuucgaggaggugaacggcaucagaaagcccaagcaccuguacgugagcaugcccaccgcccagagcaccaugaaggccgacgagaucacccccggcagauucagaaccaucgccugcggccuguuccccgcccagaucaaggccagaaacaucaucagccccgugaugggcgugaucggcuucggccacuucgugaaggacuggauggagagaaucgacaacuuccugggcgaggacugccccuuccugcccaaggccagagugcagagcgaggccuucaugagcaccaacagagccuacuuccugaacagacagagacagguggacgagagcagaauccaggacaucguggaccugauccaggccgccgaggccagcagcgccacccuguucaacgacaucgccaccccccacagcgccuggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagacccugaucgacgccaaggugaaggagaucagcaaccaggagccccugaagcuguga

SEQ ID NO: 5044 - RNA, 1287 nt, Artificial Sequence
  derived and/or modified CDS sequence (opt4) from LANV(12234)__ALD61435.1__N
augagcacccugcaggaggugcaggagggcaucacccugcacgagcagcagcugguggccgccagacagaagcugaaggacgccgagaaggccguggagguggaccccgacgacgugaacaagagcacccugcagagcagaagagccgccgugagcgcccuggagaacaagcuggccgagcugaagagacagcuggccgaccugguggccgcccagaagcuggccgccaagcccguggaccccaccggccuggagcccgacgaccaccugaaggagaagagcgcccugagauacggcaacgugcuggacgugaacgccaucgaccuggaggagcccagcggccagaccgccgacuggaaggccaucggcgccuacauccugggcuucgugauccccaucauccugaaggcccuguacaugcugagcaccagaggcagacagaccgugaaggagaacaagggcaccagaaucagauucaaggacgacagcagcuucgaggaggugaacggcaucagaaagcccaagcagcuguacgugagcaugcccaccgcccagagcaccaugaaggccgacgagaucacccccggcagauucagaaccaucgccugcggccuguuccccgcccagaucaaggccagaaacaucaucagccccgugaugggcgugaucggcuucagccacuucgugaaggacuggauggagagaaucgacgacuuccuggccgccgacugccccuuccugcccaagcccagagugcagagcgaggccuucauggccaccaacagagccuacuucaucaacagacagagacagaucgacgagagcagaaugcccgacaucauggaccugauccaggccgccgaggccggcagcgccacccuguucaacgacaucgccaccccccacagcgccuggguguucgccugcgcccccgacagaugcccccccaccgcccuguacguggccggcgugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugcugagcuggggcaaggaggccgugaaccacuuccaccugggcgacgacauggaccccgagcugagacagcuggcccagacccugaucgacaccaaggugaaggagaucagcaaccaggagccccugaagcuguga

SEQ ID NO: 5045 - RNA, 1272 nt, Artificial Sequence
  derived and/or modified CDS sequence (opt4) from LQUV(Longquan-Rs-32)__JX465422.1__N
auggccaccggcagagaccugcaggacgagcuggagcagaucgagcaggagaucacccaggccaaggccaaguacgagaagcagaaggccgccaucggcgaggagcccgacaccaucgagcugaaggugcugcagcagagagaggagaccauccacaugcuggaggagaagagaaaggagcugcugcagagaaucgcccagcagaugaagagccccagacagcccgugaagggcagagaccuggacgaggacgagcaccugagcgagagaagcacccugagauacggcaacgugaucgaccuggaggagcuggacaucgacgagcccgccggcggcagcgccgacuggcuggccaucggcaucuacaucuucagcuuccccgugcagcugcugcugaagacccuguacauccugaccaccagaggcagacagaccaucaaggagaacaagggcaacagacugagauucaaggacagcagcagcaccauggacgugaacggcgugaagacccccagacaccuguacaucagccugcccaccgcccagagcagcaugaagaccgaggagaucacccccggcagauacagaaccguggccugcggcauccugagcggcgagaugagagccagaaagcuggugagccccgugaugggcgugaucggcuucaacuaccuggccgagaaguggggcgaguacaucgacgccuuccugaugaagcagagcccccaccugcccgugagcaccggcagccccgagagcgccaccaacuucgccuaccugauccagagacaggacgugcugaacaagagcaagaccguggaguaccuggagcugugggagcaggccgagaaggccggcagacaccugguggacagaaucgagagcccccugacccccuggcuguucgccggcagccccgacagaugcccccccaccagccuguacguggccggcaucgccgagcugggcgccuucuucagcauccugcaggacaucagaaacgccaucauggccagcaagcuggugggcaccgccgaggagaagcugaagagaaagagcagcuucuaccagagcuaccugagaagaacccagagcaugggcgugcagcuggaccagagaaucaucauccuguacaugauggaguggggcaagaugaugguggaccacuuccaccugggcgacgacauggacagcgagcugagaaaggccugccagagccugaucgacgagaagguggcccaggugagcaaccaggaggcccugaagcuguga

SEQ ID NO: 5046 - RNA, 1272 nt, Artificial Sequence
  derived and/or modified CDS sequence (opt4) from LQUV(Longquan-Ra-14)__JX465414.1__N
auggccaccggcagagaccugcaggacgagcuggagcagaucgagcaggagaucacccaggccaaggccaaguacgagaagcagaaggccgccaucggcgaggagcacgacaccaucgagcugaaggugcugcagcagagagaggagaccauccacaugcuggaggagaagagaaaggagcugcugcagagaaucgcccagcagaugaagagccccagacagcccgugaagggcagagaccuggacgaggacgagcaccugagcgagagaagcacccugagauacggcaacgugaucgaccuggaggagcuggacaucgacgagcccgccggcggcagcgccgacuggcuggccaucggcaucuacaucuucagcuuccccgugcagcugcugcugaagacccuguacauccugaccaccagaggcagacagaccaucaaggagaacaagggcaacagacugagauucaaggacagcagcagcaccauggacgugaacggcgugaagacccccagacaccuguacaucagccugcccaccgcccagagcagcaugaagaccgaggagaucacccccggcagauacagaaccguggccugcggcauccugagcggcgagaugagagccagaaagcuggugagccccgugaugggcgugaucggcuucaacuaccuggccgagaaguggggcgaguacaucgacgccuuccugaugaagcagagcccccaccugcccgugagcaccggcagccccgagagcgccaccaacuucgccuaccugauccagagacaggacgugcugaacaagagcaagaccguggaguaccuggagcugugggagcaggccgagaaggccggcagacaccugguggacagaaucgagagcccccugacccccuggcuguucgccggcagccccgacagaugcccccccaccagccuguacguggccggcaucgccgagcugggcgccuucuucagcauccugcaggacaucagaaacgccaucauggccagcaagcuggugggcaccgccgaggagaagcugaagagaaagagcagcuucuaccagagcuaccugagaagaacccagagcaugggcgugcagcuggaccagagaaucaucauccuguacaugauggaguggggcaagaugaugguggaccacuuccaccugggcgacgacauggacagcgagcugagaaaggccugccagagccugaucgacgagaagguggcccaggugagcaaccaggaggcccugaagcuguga

SEQ ID NO: 5047 - RNA, 1272 nt, Artificial Sequence
  derived and/or modified CDS sequence (opt4) from LQUV(Longquan-Ra-25)__JX465415.1__N
auggccaccggcagagaccugcaggacgagcuggagcagaucgagcaggagaucacccaggccaaggccaaguacgagaagcagaaggccgccaucggcgaggagcccgacaccaucgagcugaaggugcugcagcagagagaggagaccauccacaugcuggaggagaagagaaaggagcugcugcagagaaucgcccagcagaugaagagccccaagcagcccgugaagggcagagaccuggacgaggacgagcaccugagcgagagaagcacccugagauacggcaacgugaucgaccuggaggagcuggacaucgacgagcccgccggcggcagcgccgacuggcuggccaucggcaucuacaucuucagcuuccccgugcagcugcugcugaagacccuguacauccugaccaccagaggcagacagaccaucaaggagaacaagggcaacagacugagauucaaggacagcagcagcaccauggacgugaacggcgugaagacccccagacaccuguacaucagccugcccaccgcccagagcagcaugaagaccgaggagaucacccccggcagauacagaaccguggccugcggcauccugagcggcgagaugagagccagaaagcuggugagccccgugaugggcgugaucggcuucaacuaccuggccgagaaguggggcgaguacaucgacgccuuccugaugaagcagagcccccaccugcccgugagcaccggcagccccgagagcgccaccaacuucgccuaccugauccagagacaggacgugcugaacaagagcaagaccguggaguaccuggagcugugggagcaggccgagaaggccggcagacaccugguggacagaaucgagagcccccugacccccuggcuguucgccggcagccccgacagaugcccccccaccagccuguacguggccggcaucgccgagcugggcgccuucuucagcauccugcaggacaucagaaacgccaucauggccagcaagcuggugggcaccgccgaggagaagcugaagagaaagagcagcuucuaccagagcuaccugagaagaacccagagcaugggcauccagcuggaccagagaaucaucauccuguacaugauggaguggggcaagaugaugguggaccacuuccaccugggcgacgacauggacagcgagcugagaaaggccugccagagccugaucgacgagaagguggcccaggugagcaaccaggaggcccugaagcuguga

SEQ ID NO: 5048 - RNA, 1287 nt, Artificial Sequence
  derived and/or modified CDS sequence (opt4) from NYV(RI-1)__U09488.1__N
augagcacccugaaggaggugcaggacaacaucacccugcacgagcagcagcuggugaccgccagacagaagcugaaggacgccgagaaggccguggagguggaccccgacgacgugaacaagagcacccugcagggcagaagagccgccgugagcgcccuggagaccaagcugggcgagcugaagagacagcuggccgaccugaucgccgcccagaagcuggccagcaagcccaucgaccccaccggcaucgagcccgacgaccaccugaaggagaagagcagccugagauacggcaacgugcuggacgugaacagcaucgaccuggaggagcccagcggccagaccgccgacuggaaggccaucggcauguacauccugagcuucgccauccccaucauccugaaggcccuguacaugcugagcaccagaggcagacagaccgugaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucaacuucuucgugaaggacuggauggacagaaucgacgacuuccuggccgagagaugccccuuccugcccgagcccagagaccccaaggacgccgcccugggcaccaacagagccuacuucaucaccagacaggcccagguggacgagagcaaggugguggacaucgaggagcugaucguggacgccagagccgagagcgccacccuguucgccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugauccacuggggcaaggaggccgugaaccacuuccaccugggcgacgacauggaccccgagcugagagagcuggcccaggcccugguggacgccaaggugaaggagaucagcaaccaggagccccugaagcuguga

SEQ ID NO: 5049 - RNA, 1302 nt, Artificial Sequence
  derived and/or modified CDS sequence (opt4) from PUUV(K27)__L08804.1__N
augagcgaccugaccgacauccaggaggagaucaccagacacgagcagcagcuggugguggccagacagaagcugaaggacgccgagagagccguggagguguaccccgacgacgugaucaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucaagagccccaacgcccccuggguguucgccugcgcccccgacagaagcccccccaccugcaucuacguggccggcauggccgagcugggcgccuucuucagcauccugcaggacaugagaaacaccaucauggccagcaagaccgugggcaccgccgaggagaagcugaagagaaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5050 - RNA, 1302 nt, Artificial Sequence
  derived and/or modified CDS sequence (opt4) from PUUV(KS13/855)__KX815394.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagguggaguuccugaagaagaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5051 - RNA, 1302 nt, Artificial Sequence
  derived and/or modified CDS sequence (opt4) from PUUV(KS14/118)__KX815395.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaagaacuggcccgagagaaucaaggaguucauggagaaggagugccccuucaucaagcccgaggugaagcccggcacccccgcccaggagguggaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5052 - RNA, 1302 nt, Artificial Sequence
  derived and/or modified CDS sequence (opt4) from PUUV(LT15/201)__KX757841.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaucgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagguggaguuccugaagaagaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5053 - RNA, 1302 nt, Artificial Sequence
  derived and/or modified CDS sequence (opt4) from PUUV(PUU/Ernstbrunn/Cg641/1995)__AJ888752.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucaagagacccaagcaccuguacgugagcaugcccaccgcccagagcaccaugaaggccgagaagcugacccccggcagauucagaaccaucgugugcggccuguuccccacccagauccaggugagaaacaucaugagccccgugaugggcgugaucggcuucagcuucuucgugaaggacuggagcgagagagugagagacuucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugaucgacuacgccgccagcggcgaccccaccagccccgacaaccuggagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5054 - RNA, 1302 nt, Artificial Sequence
  derived and/or modified CDS sequence (opt4) from PUUV(PUU/Klippitztoerl/Cg9/1995)__AJ888751.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccggcggccagaccgccgacugguacaccaucggcguguacgugaucggcuucacccugcccaucauccugaaggcccuguacauguucagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagacuucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugaucgacuacgccgccagcggcgaccccaccagccccgacaaccuggagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5055 - RNA, 1302 nt, Artificial Sequence
  derived and/or modified CDS sequence (opt4) from PUUV(Balkan-1)__AJ314600.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagaguucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugcuggacuacgccgccagcggcgaccccaccagccacgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5056 - RNA, 1302 nt, Artificial Sequence
  derived and/or modified CDS sequence (opt4) from PUUV(Balkan-2)__AJ314601.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucguguucggccuguuccccacccagauccaggugagaaacaucaugagccccgugaugggcgugaucggcuucagcuucuucgugaaggacuggagcgagagagugagagaguucauggagaaggagugccccuucaucaagcccgagaucaagcccggcgcccccccccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5057 - RNA, 1302 nt, Artificial Sequence
  derived and/or modified CDS sequence (opt4) from PUUV(Baltic/205Cg/00)__AJ314599.1__N
augagcgaccuggccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucaaggaguucauggagaaggagugccccuucaucaagcccgaggugaagcccggcacccccacccaggagguggaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaagcaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5058 - RNA, 1302 nt, Artificial Sequence
  derived and/or modified CDS sequence (opt4) from PUUV(Baltic/49Cg/00)__AJ314598.1__N
augagcgaccuggccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucaaggaguucauggagaaggagugccccuucaucaagcccgaggugaagcccggcacccccgcccaggagguggaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5059 - RNA, 1302 nt, Artificial Sequence
  derived and/or modified CDS sequence (opt4) from PUUV(Pallasjarvi/63Cg/98)__AJ314597.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcacccccgcccaggagguggagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5060 - RNA, 1302 nt, Artificial Sequence
  derived and/or modified CDS sequence (opt4) from PUUV(Sotkamo 2009)__HE801633.1__N
augagcgaccugaccgacauccaggaggacaucaccagacacgagcagcagcugaucguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5061 - RNA, 1302 nt, Artificial Sequence
  derived and/or modified CDS sequence (opt4) from PUUV(CG 13891)__U22423.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagagagcauggagaaggagugccccuuccugaagcccgacgugaagcccggcacccccgcccaggagaccgaguuccugaagagaaacaagaucuacuucaugcagagacaggaggugcuggacaagaaccacguggccgagaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5062 - RNA, 1302 nt, Artificial Sequence
  derived and/or modified CDS sequence (opt4) from PUUV(CG1820)__M32750.1__N
augagcgaccugaccgacauccaggaggagaucaccagacacgagcagcagcuggugguggccagacagaagcugaaggacgccgagagagccguggagguggaccccgacgacgugaacaagagcacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcagagagaugguggaccacuuccaccugggcgacgacauggaccccgagcugagaggccuggcccagagccugaucgaccagaaggugaaggagaucagcaaccaggagccccugaagaucuga

SEQ ID NO: 5063 - RNA, 1302 nt, Artificial Sequence
  derived and/or modified CDS sequence (opt4) from PUUV(Bussjo_95-1)__AM746297.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5064 - RNA, 1302 nt, Artificial Sequence
  derived and/or modified CDS sequence (opt4) from PUUV(CG144)__AF367064.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcaucuacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5065 - RNA, 1302 nt, Artificial Sequence
  derived and/or modified CDS sequence (opt4) from PUUV(CG168)__AF367065.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcauccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5066 - RNA, 1302 nt, Artificial Sequence
  derived and/or modified CDS sequence (opt4) from PUUV(CG17/Baskiria-2001)__AF442613.1__N
augagcgaccuggccgacauccaggaggagaucaccagacacgagcagcagcugguggccgccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5067 - RNA, 1302 nt, Artificial Sequence
  derived and/or modified CDS sequence (opt4) from PUUV(CG215)__AF367066.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagacccugaucgaccagaaggugaaggagaucagcaaccaggagccccugaagaucuga

SEQ ID NO: 5068 - RNA, 1302 nt, Artificial Sequence
  derived and/or modified CDS sequence (opt4) from PUUV(CG315)__AF367068.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaugaagcccgaggugaagcccggcacccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5069 - RNA, 1302 nt, Artificial Sequence
  derived and/or modified CDS sequence (opt4) from PUUV(CRF161)__AF367069.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5070 - RNA, 1302 nt, Artificial Sequence
  derived and/or modified CDS sequence (opt4) from PUUV(CRF308)__AF367070.1__N
augagcgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagaagaacaagaucuacuucaugcacagacaggacgugcuggacaagaaccacguggccgacauggacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5071 - RNA, 1302 nt, Artificial Sequence
  derived and/or modified CDS sequence (opt4) from PUUV(CRF366)__AF367071.1__N
augaccgaccugaccgacauccaggaggacaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcaucuacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagaagaacaagaucuacuucaugcacagacaggacgugcuggacaagaaccacguggccgacaucgacaagcugaucgacuacgccgccagcggcgaccccaccagccccgacaacaucgacagccccaacacccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5072 - RNA, 1302 nt, Artificial Sequence
  derived and/or modified CDS sequence (opt4) from PUUV(Djaknebole_98-1)__AM746310.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5073 - RNA, 1302 nt, Artificial Sequence
  derived and/or modified CDS sequence (opt4) from PUUV(Fusong 114-05)__EF488804.1__N
augagcgaccugaaggacauccaggaggacaucgccagacacgagcagcagcuggugguggccagacagaagcugagagacgccgagaaggccguggagauggaccccgacgacgugaacaagaacacccugcaggccagacagcagaccgugagcgcccuggaggacaagaucgccgacuucaagagaagaauggccgacaucgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucgaguucacccugcccaucauccugaaggcccuguacaugcugagcaccagaggcagacagaccgccaaggagaacaagggcaccagaaucagauucaaggacgacaccagcuucgaggacgugaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgccaaggacuggcccgacagaaucaaggaguucauggagaaggagugccccuucaucaagcccgaggugaagcccggcacccccgccaaggagguggagauccugaagagaaacaagaucuacuucaugcagagacagggcgugcuggacaagaaccacgugcccgacaucgacaagcugaucgacuacgccgccagcggcgaccccaccagccccagaaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5074 - RNA, 1302 nt, Artificial Sequence
  derived and/or modified CDS sequence (opt4) from PUUV(Fusong 199-05)__EF488803.1__N
augagcgaccugaaggacauccaggaggacaucgccagacacgagcagcagcugguggccgccagacagaagcugagagacgccgagaaggccguggagauggaccccgacgacgugaacaagaacacccugcaggccagacagcagaccgugagcgcccuggaggacaagaucgccgacuucaagagaagaauggccgacaucgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacgugaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgccaaggacuggcccgacagaaucaaggaguucauggagaaggagugccccuucaucaagcccgaggugaagcccggcacccccgccaaggagguggagauccugaagagaaacaagaucuacuucaugcagagacaggacgugcuggacaagaaccacgugcccgacaucgacaagcugaucgacuacgccgccagcggcgaccccaccagccccgagaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5075 - RNA, 1302 nt, Artificial Sequence
  derived and/or modified CDS sequence (opt4) from PUUV(Fusong 200-05)__EF211820.1__N
augagcgaccugaaggacauccaggaggacaucgccagacacgagcagcagcuggugguggccagacagaagcugagagacgccgagaaggccguggagauggaccccgacgacgugaacaagaacacccugcaggccagacagcagaccgugagcgcccuggaggacaagaucgccgacuucaagagaagaauggccgacaucgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacgugaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgccaaggacuggcccgacagaaucaaggaguucauggagaaggagugccccuucaucaagcccgaggugaagcccggcacccccgccaaggagguggagauccugaagagaaacaagaucuacuucaugcagagacaggacgugcuggacaagaaccacgugcccgacaucgacaagcugaucgacuacgccgccagcggcgaccccaccagccccgagaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5076 - RNA, 1302 nt, Artificial Sequence
  derived and/or modified CDS sequence (opt4) from PUUV(Fusong 900-06)__EF488806.1__N
augagcgaccugaaggacauccaggaggacaucgccagacacgagcagcagcuggugguggccagacagaagcugagagacgccgagaaggccguggagauggaccccgacgacgugaacaagaacacccugcaggccagacagcagaccgugagcgcccuggaggacaagaucgccgacuucaagagaagaauggccgacaucgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacgugaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgccaaggacuggcccgacagaaucaaggaguucauggagaaggagugccccuucaucaagcccgaggugaagcccggcacccccgccaaggagguggagauccugaagagaaacaagaucuacuucaugcagagaagagacgugcuggacaagaaccacgugcccgacaucgacaagcugaucgacuacgccgccagcggcgaccccaccagccccgagaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuacaagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5077 - RNA, 1302 nt, Artificial Sequence
  derived and/or modified CDS sequence (opt4) from PUUV(Gumboda_98-2)__AM746316.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggagaagaaccacguggccgacaucgacaagcugaucgacuacgccgccagcggcgaccccaccagccccgacaacaucgagagccccaacgcccccuggguguucagcugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5078 - RNA, 1302 nt, Artificial Sequence
  derived and/or modified CDS sequence (opt4) from PUUV(Gumboda_98-4)__AM746318.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucagcugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5079 - RNA, 1302 nt, Artificial Sequence
  derived and/or modified CDS sequence (opt4) from PUUV(Kamiiso-8Cr-95)__AB010730.1__N
augagcgaccugaaggacauccaggaggacaucaccagacacgagcagcagcuggugguggccagacagaagcugagagacgccgagaaggccguggagauggaccccgacgacgugaacaagaacacccugcaggccagacagcagaccgugagcgcccuggaggacaagcuggccgacuucaagagaagaauggccgacguggugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagaucacccccggcagauucagaaccaucgugugcggccuguuccccacccagauccaggugagaaacaucaugagccccgugaugggcgugaucggcuucagcuucuucgugaaggacuggcccgagagaaucaaggaguucauggagaaggagugccccuucaucaagcccgaggugaagcccggcacccccgccaaggagguggagauccugaagagaaacaagguguacuucaugcagagacaggacgugcuggacaagaaccacgugcccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5080 - RNA, 1302 nt, Artificial Sequence
  derived and/or modified CDS sequence (opt4) from PUUV(Mu/07/1219)__KJ994776.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5081 - RNA, 1302 nt, Artificial Sequence
  derived and/or modified CDS sequence (opt4) from PUUV(Opina916)__AF294652.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccguggaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggaggccgaguuccugaagaagaacagaaucuacuucaugcagagacaggaggugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5082 - RNA, 1302 nt, Artificial Sequence
  derived and/or modified CDS sequence (opt4) from PUUV(Palbole_98-1)__AM746327.1__N
augagcgaccugaccgacauccaggaggacaucaccugccacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5083 - RNA, 1302 nt, Artificial Sequence
  derived and/or modified CDS sequence (opt4) from PUUV(Palbole_98-2)__AM746328.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggcuucgcccaggcccugaucgaccagaaggugaaggagaucagcaaccaggacccccugaagaucuga

SEQ ID NO: 5084 - RNA, 1302 nt, Artificial Sequence
  derived and/or modified CDS sequence (opt4) from PUUV(Palbole_98-3)__AM746329.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacagcaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5085 - RNA, 1302 nt, Artificial Sequence
  derived and/or modified CDS sequence (opt4) from PUUV(PUUV/Ardennes/Mg156/2011)__KT247592.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggagguggaguuccugaagagaaacaagaucuacuucaugcagagacaggacgugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5086 - RNA, 1302 nt, Artificial Sequence
  derived and/or modified CDS sequence (opt4) from PUUV(PUUV/Jelgava/Mg136/2008)__JN657230.1__N
augagcgaccuggccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccguggugugcggccuguuccccacccagauccaggugagaaacaucaugagccccgugaugggcgugaucggcuucagcuucuucgugaaggacuggcccgacagaaucaaggaguucauggagaaggagagccccuucaucaagcccgacgugaagcccggcacccccgcccaggagguggaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5087 - RNA, 1302 nt, Artificial Sequence
  derived and/or modified CDS sequence (opt4) from PUUV(PUUV/Jelgava/Mg140/2008)__JN657231.1__N
augagcgaccuggccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccguggugugcggccuguuccacacccagauccaggugagaaacaucaugagccccgugaugggcgugaucggcuucagcuucuucgugaaggacuggcccgacagaaucaaggaguucauggagaaggagugccccuucaucaagcccgacgugaagcccggcacccccgcccaggagguggaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5088 - RNA, 1302 nt, Artificial Sequence
  derived and/or modified CDS sequence (opt4) from PUUV(PUUV/Jura/Mg2/2010)__KT247596.2__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgagaucaagcccggcacccccgcccaggaggccgaguuccugaagagaaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5089 - RNA, 1302 nt, Artificial Sequence
  derived and/or modified CDS sequence (opt4) from PUUV(PUUV/Madona/Mg233/2008)__JN657232.1__N
augagcgaccuggccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucagcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucaaggaguucauggagaaggagugccccuucaucaagcccgacgugaagcccggcacccccgcccaggagaucgaguuccugaagagaaacaagguguacuucaugaacagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5090 - RNA, 1302 nt, Artificial Sequence
  derived and/or modified CDS sequence (opt4) from PUUV(PUUV/Orleans/Mg23/2010)__KT247594.1__N
augagcgaccugaccgacauccaggaggugaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucaaggaguucauggagaaggagugccccuucaucaagcccgaggugaagcccggcacccccgugaaggaggccgaguuccugaagaagaacagaguguacuucaugcagagacaggacgugcuggacaagaaccacguggccgacaucgacaagcugaucgacuacgccgccgccggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5091 - RNA, 1302 nt, Artificial Sequence
  derived and/or modified CDS sequence (opt4) from PUUV(Tobetsu-60Cr-93)__AB010731.1__N
augagcgaccugaaggacauccaggaggacaucaccagacacgagcagcagcuggugguggccagacagaagcugagagacgccgagaaggccguggagauggaccccgacgacgugaacaagaacacccugcaggccagacagcagaccgugagcgcccuggaggacaagcuggccgacuucaagagaagaauggccgacguggugagcagaaagaagauggacaccaagcccgccgaccccaccggcaucgagcccgacgaccaccugaaggacagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagaucacccccggcagauucagaaccaucgugugcggccuguuccccacccagauccaggugagaaacaucaugagccccgugaugggcgugaucggcuucagcuucuucgugaaggacuggcccgagagaaucaaggaguucauggagaaggagugccccuucaucaagcccgaggugaagcccggcacccccgccaaggagguggagauccugaagagaaacaagguguacuucaugcagagacaggacgugcuggacaagaaccacgugcccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5092 - RNA, 1302 nt, Artificial Sequence
  derived and/or modified CDS sequence (opt4) from PUUV(Vranica)__U14137.1__N
augagcgaccugaccgacauccaggaggacaucaccagacacgagcagcagcuggugguggccagacagaagcugaaggacgccgagaaggccguggagauguaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagauacagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccacccaggagaucgaguuccugaagaagaacaagguguacuucauggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggacccccugaagaucuga

SEQ ID NO: 5093 - RNA, 1302 nt, Artificial Sequence
  derived and/or modified CDS sequence (opt4) from PUUV(P360)__L11347.1__N
augagcgaccugaccgacauccaggaggagaucaccagacacgagcagcagcuggugguggccagacagaagcugaaggacgccgagagagccguggagguguaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5094 - RNA, 1302 nt, Artificial Sequence
  derived and/or modified CDS sequence (opt4) from PUUV(Aijajarvi/Mg7/05)__GQ339476.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaagggcugggccgacagaaucagagaguucauggagaaggagugccccuucaucaagcccgaggugaagcccggcacccccacccaggagguggaguuccugaagaagaacaagguguacuuccuggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5095 - RNA, 1302 nt, Artificial Sequence
  derived and/or modified CDS sequence (opt4) from PUUV(Bavaria 151/05)__EU439968.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuuccugaagcccgagaucaagcccggcacccccgcccaggaggccgaguuccugaagaagaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5096 - RNA, 1302 nt, Artificial Sequence
  derived and/or modified CDS sequence (opt4) from PUUV(Bavaria 159/05)__EU439972.1__N
augagcgaccugaccgacauccacgaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaucaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5097 - RNA, 1299 nt, Artificial Sequence
  derived and/or modified CDS sequence (opt4) from PUUV(Bavaria CG 33/04)__DQ016430.2__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaucaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5098 - RNA, 1302 nt, Artificial Sequence
  derived and/or modified CDS sequence (opt4) from PUUV(Bavaria CG 34/04)__AY954723.2__N
augagcgaccugaccgacauccaggaggacaucaccagacacgagcagcagcuggugguggccagacagaagcugaaggacgccggcaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5099 - RNA, 1302 nt, Artificial Sequence
  derived and/or modified CDS sequence (opt4) from PUUV(Bavaria CG 41/04)__DQ016432.2__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaaccuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5100 - RNA, 1302 nt, Artificial Sequence
  derived and/or modified CDS sequence (opt4) from PUUV(Bavaria CG 9/04)__AY954722.2__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaugaagcccggcauccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5101 - RNA, 1302 nt, Artificial Sequence
  derived and/or modified CDS sequence (opt4) from PUUV(Bergsjobo/Mg25/05)__GQ339483.1__N
augagcgaccuggccgacauccaggacgagaucaccagacacgagcagcagcugguggccgccagacagaagcugaaggacgccgagagagccguggagguggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagguggaguuccugaagaagaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5102 - RNA, 1302 nt, Artificial Sequence
  derived and/or modified CDS sequence (opt4) from PUUV(CG14444)__AJ277075.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggaggccgaguuccugaagagaaacaagaucuacuucaugcagagacaggaggugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5103 - RNA, 1302 nt, Artificial Sequence
  derived and/or modified CDS sequence (opt4) from PUUV(CG14445)__AJ277076.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggaggccgaguuccugaagagaaacaucaucuacuucaugcagagacaggaggugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5104 - RNA, 1302 nt, Artificial Sequence
  derived and/or modified CDS sequence (opt4) from PUUV(CG1820/POR)__KT885052.1__N
augagcgaccugaccgacauccaggaggagaucaccagacacgagcagcagcuggugguggccagacagaagcugaaggacgccgagagagccguggagguggaccccgacgacgugaacaagagcacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagaagaucagagaguucauggagaaggagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5105 - RNA, 1302 nt, Artificial Sequence
  derived and/or modified CDS sequence (opt4) from PUUV(Couvin/59Cg/97)__AJ277034.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggaggccgaguuccugaagagaaacaagaucuacuucaugcagagacaggacgugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5106 - RNA, 1302 nt, Artificial Sequence
  derived and/or modified CDS sequence (opt4) from PUUV(Evo/12Cg/93)__Z30702.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgagaucaagcccggcacccccgcccaggagauggagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugagaaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5107 - RNA, 1302 nt, Artificial Sequence
  derived and/or modified CDS sequence (opt4) from PUUV(Evo/14Cg/93)__Z30704.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccaacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgagaucaagcccggcacccccgcccaggagauggagaugcugaagagaaacaagaucuacuucaugcagagacaggacgugcuggacaagaaccacguggccgacaucgacaagcugaucgacuacgccgccagcggcggccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5108 - RNA, 1302 nt, Artificial Sequence
  derived and/or modified CDS sequence (opt4) from PUUV(Evo/15Cg/93)__Z30705.1__N
augagcgaccugaccgacauccaggaggacaucaccagacacgagcagcagcuggugguggccagacagggccugaaggacgccgagagagccguggagguggaccccgacgacgugaacaagaacgcccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacguguucgacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgagaucaagcccggcacccccgcccaggagauggagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5109 - RNA, 1302 nt, Artificial Sequence
  derived and/or modified CDS sequence (opt4) from PUUV(Faboviken/Mg26/05)__GQ339484.1__N
augagcgaccuggccgacauccaggacgagaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagaucagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagguggaguuccugaagaagaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5110 - RNA, 1302 nt, Artificial Sequence
  derived and/or modified CDS sequence (opt4) from PUUV(Fyn)__AJ238791.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagcugaagcccggcaccaacgcccaggaggccgaguuccugaagaagaacagaguguacuuccugaacagacaggacgugcuggacaagaaccacguggccgacaucgacaagcugaucgacuacgccgccagcggcgaccccaccagccccgacaacaucgaggcccccaacgcccccuggguguucagcugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5111 - RNA, 1302 nt, Artificial Sequence
  derived and/or modified CDS sequence (opt4) from PUUV(Fyn131)__AJ278093.1__N
augagcgaccugaccgacauccaggaggacaucaccagacacgagcagcagcuggugguggccagacagaagcugaaggacgccgagaaggccguggagauggaccccgacgacgugaacaagaacacccuggaggccagacagcagaccgugagcgcccuggaggacaagcuggccgacuucaagagaagaaugaccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccccagcaccaugaaggccgaggagcugacccccggcagauucagaaccaucgugugcggccuguuccccacccagauccaggugagaaacaucaugagccccgugaugggcgugaucggcagcagcuucuucgugaaggacugggccgacagaaucagagaguucauggagaaggagugccccuucgugaagcccgagcugaagcccggcaccaacgcccaggaggccgaguuccugaagaagaacagaguguacuucaugaacagacaggacgugcuggacaagaaccacguggccgacaucgacaagcugaucgacuacgccgccagcggcgaccccaccugccccgacaacaucgaggcccccaacgcccccuggggcuucgccugcgccccccacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcagagagaugguggaccacuuccaccugggcgacgacauggaccccgagcugagaggccuggcccaggcccugaucaaccagaaggugaaggagaucagcaaccaggagccccugaagaucuga

SEQ ID NO: 5112 - RNA, 1302 nt, Artificial Sequence
  derived and/or modified CDS sequence (opt4) from PUUV(Fyn47)__AJ278092.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccccagcaccaugaaggccgaggagcugacccccggcagauucagaaccaucgugugcggccuguuccccacccagauccaggugagaaagaucaugagccccgugaugggcgugaucggcuucagcuucuucgugaaggacuggguggagagaaucagagaguucauggagaaggagugccccuucgugaagcccgagcugaagcccggcaccaacgcccaggaggccgaguuccugaagaagaacagaguguacuucaugaacagacaggacgugcuggacaagaaccacguggccgacaucgacaagcugaucgacuacgccgccagcggcgaccccaccagccccgacaacaucgaggcccccaacgcccccuggguguucgccugcgccccccacagaugcccccccaccugcaucuacguggccggcauggccgagcugggcgccuucuucagcauccugcaggacaugagaaacgccaucauggccagcaagaccgugggcaccgccgaggagaagcugaagaagaagagcagcuucuaccagagcuaccugagaagaacccagagcgugggcauccagcuggaccagagaaucauccugcuguacaugcuggaguggggcagagagaugguggaccacuuccaccugggcgacgacauggaccccgagcugagaggccuggcccaggcccugaucgaccagaaggugaaggagaucagcaaccaggagccccugaagaucuga

SEQ ID NO: 5113 - RNA, 1302 nt, Artificial Sequence
  derived and/or modified CDS sequence (opt4) from PUUV(Gomselga)__AJ238790.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaaagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggaccccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggagaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucgugagccccgugaugggcgugaucggcuucagcuucuucgugaaggacuggagccagagaaucaccgaguucauggagaaggagugccccuucaucaagcccgaggugaagcccggcacccccgcccaggagaucgagauguucaagagaaacaagaucuacuucaugcagagacaggacgugcuggacaagaaccacguggccgacaucgacaagagcaucgacuacgccgccagcgaggaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5114 - RNA, 1302 nt, Artificial Sequence
  derived and/or modified CDS sequence (opt4) from PUUV(Gyttjea/Mg19/05)__GQ339480.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucgccuucuucgugaagggcugggccgacagaaucagagaguucauggagaaggagugccccuucaucaagcccgaggugaagcccggcacccccacccaggagaucgaguuccugaagaagaacaagguguacuuccuggacagacagaccgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5115 - RNA, 1302 nt, Artificial Sequence
  derived and/or modified CDS sequence (opt4) from PUUV(Karhumaki)__AJ238788.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaaagauggccgacgccgugagcagaaagaagauggacaccaagcccaccgaccccaccggcaugaagcccgacgugcaccugaaggagagaagcagccuggaguacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcacccccgcccaggagaucgagaugcugagaagaaacaagaucuacuucaugcagagacaggacgugcuggacaagaaccacguggccgacaucgacaagcugaucgaccuggccgccagcggcgaccccaccagccccgacaacaucgacagccccaacgcccccuggguguucgccugcgcccccgugagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5116 - RNA, 1302 nt, Artificial Sequence
  derived and/or modified CDS sequence (opt4) from PUUV(Kolodozero)__AJ238789.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccugauccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcaccagcgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcaucccccuggaccagagaaucauccugcuguucaugcuggaguggggccaggagaugguggaccacuuccaccugggcgacgacauggaccccgagcugagaggccuggcccaggcccugaucgaccagaaggugaaggagaucagcaaccaggagccccugaagaucuga

SEQ ID NO: 5117 - RNA, 1302 nt, Artificial Sequence
  derived and/or modified CDS sequence (opt4) from PUUV(Kuhmo/X11)__GU808825.1__N
augagcgaccugaccgacauccaggaggacaucaccagacacgagcagcagcuggugguggccagacagaagcugaaggacgccgagagagccgugggcguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcacccccgcccaggagaucgagaugcugaagagaaacagaaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccagcgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5118 - RNA, 1302 nt, Artificial Sequence
  derived and/or modified CDS sequence (opt4) from PUUV(Kuhmo/X5)__GU808824.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagaaucagagaguucauggagaaggagugccccuucaucaagcccgaggugaagcccggcacccccgcccaggagaucgagaugcugaagagaaacagaaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5119 - RNA, 1302 nt, Artificial Sequence
  derived and/or modified CDS sequence (opt4) from PUUV(Ljustrask/Mg20/05)__GQ339481.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucgccuucuucgugaagggcugggccgacagaaucagagaguucauggagaaggagugccccuucaucaagcccgaggugaagcccggcacccccacccaggagaucgaguuccugaagaagaacaagguguacuuccuggacagacagaacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5120 - RNA, 1302 nt, Artificial Sequence
  derived and/or modified CDS sequence (opt4) from PUUV(Mangelbo/Mg1/05)__GQ339485.1__N
augagcgaccugaccgacauccaggacgagaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcgacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggacaaggagugccccuucaucaagcccgaggugaagcccggcacccccgcccaggagaucgaguuccugaagaagaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccugacccaggcccugaucgaccagaaggugaaggagaucagcaaccccgagccccugaagaucuga

SEQ ID NO: 5121 - RNA, 1302 nt, Artificial Sequence
  derived and/or modified CDS sequence (opt4) from PUUV(Momignies/55Cg/96)__AJ277033.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagaagcaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggaggccgaguuccugaagagaaacaagaucuacuucaugcagagacaggacgugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugagcgacgacauggaccccgagcugagaggccuggcccaggcccugaucgaccagaaggugaaggagaucagcaaccaggagccccugaagaucuga

SEQ ID NO: 5122 - RNA, 1302 nt, Artificial Sequence
  derived and/or modified CDS sequence (opt4) from PUUV(Montbliart/23Cg/96)__AJ277031.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgcccaggaggccgaguuccugagaagaaacaagaucuacuucaugcagagacaggaggugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5123 - RNA, 1302 nt, Artificial Sequence
  derived and/or modified CDS sequence (opt4) from PUUV(MuEb10Karlstadt/10)__JN696373.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaucaagcccggcacccccgugcaggaggccgaguuccugaagagaaacaagguguacuucaugcagagacaggaggugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5124 - RNA, 1302 nt, Artificial Sequence
  derived and/or modified CDS sequence (opt4) from PUUV(MuEb12Lackenberg/10)__JN696374.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgagaugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5125 - RNA, 1302 nt, Artificial Sequence
  derived and/or modified CDS sequence (opt4) from PUUV(Munga/Mg16/05)__GQ339487.1__N
augagcgaccugaccgacauccaggacgagaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagaucgaguuccugaagaagaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5126 - RNA, 1302 nt, Artificial Sequence
  derived and/or modified CDS sequence (opt4) from PUUV(Munga/Mg2/05)__GQ339486.1__N
augagcgaccugaccgacauccaggacgagaucaccagacacgagcagcagcugguggccgccagacagaagcugaaggacgccgagagagccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacaugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgagagaaucagagaguucauggagaaggagugccccuucaucaagcccgaggugaagcccggcacccccgcccaggagaucgaguuccugaagaagaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5127 - RNA, 1302 nt, Artificial Sequence
  derived and/or modified CDS sequence (opt4) from PUUV(PUU/Cg-Erft)__AJ238779.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucaagaaguucauggagaaggagugccccuucaucaagcccgaggugaagcccggcacccccagccaggaggccgaguuccugaagaugaacagaaucuacuucaugcagagacaggaggugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5128 - RNA, 1302 nt, Artificial Sequence
  derived and/or modified CDS sequence (opt4) from PUUV(Puu/Kazan)__Z84204.1__N
augagcgaccugaccgacauccaggaggagaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagacuucauggagaaggagagccccuucaucaagcccgaggugaagcccggcacccccgcccaggagaucgaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5129 - RNA, 1302 nt, Artificial Sequence
  derived and/or modified CDS sequence (opt4) from PUUV(PUU/Mignovillard/CgY02/2005)__AM695638.1__N
augggcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggaccgacagaaucagagaguucauggagaaggagugccccuucaucaagcccgagaugaagcccggcacccccgcccaggaggccgaguuccugaagagaaacaagaucuacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5130 - RNA, 1302 nt, Artificial Sequence
  derived and/or modified CDS sequence (opt4) from PUUV(PUUV/Croatia_Gerovo/Mg938/2008)__KC676609.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaugggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagacuucauggagaaggagugccccuucaucaagcccgagaucaagcccggcaccccccagcaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5131 - RNA, 1302 nt, Artificial Sequence
  derived and/or modified CDS sequence (opt4) from PUUV(PUUV/Croatia_Gerovo/Mg979/2008)__KC676613.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagacuucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5132 - RNA, 1302 nt, Artificial Sequence
  derived and/or modified CDS sequence (opt4) from PUUV(PUUV/Konnevesi/Mg_M114B/2005)__JQ319171.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccacuucggcgacgacauggaccccgagcugagaggccuggcccaggcccugaucgaccagaaggugaaggagaucagcaaccaggagccccugaagaucuga

SEQ ID NO: 5133 - RNA, 1302 nt, Artificial Sequence
  derived and/or modified CDS sequence (opt4) from PUUV(PUUV/Konnevesi/Mg_M94A/2005)__JQ319163.2__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucaaggaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggaggaggugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggccaugaucgaccagaaggugaaggagaucagcaaccaggagccccugaagaucuga

SEQ ID NO: 5134 - RNA, 1302 nt, Artificial Sequence
  derived and/or modified CDS sequence (opt4) from PUUV(PUUV/Konnevesi/Mg_O14B/2005)__JQ319166.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5135 - RNA, 1302 nt, Artificial Sequence
  derived and/or modified CDS sequence (opt4) from PUUV(PUUV/Konnevesi/Mg_O22B/2005)__JQ319168.2__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgagaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccacgcccaggcccugaucgaccagaaggugaaggagaucagcaaccaggagccccugaagaucuga

SEQ ID NO: 5136 - RNA, 1302 nt, Artificial Sequence
  derived and/or modified CDS sequence (opt4) from PUUV(PUUV/Konnevesi/Mg_O57A/2005)__JQ319161.2__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccaccagaauccaggugagaaacaucaugagccccgugaugggcgugaucggcuucagcuucuucgugaaggacuggcccgagagaaucaaggaguucauggagaaggagugcagcuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggaggaggugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaacgugaaggagaucagcaaccaggagccccugaagaucuga

SEQ ID NO: 5137 - RNA, 1302 nt, Artificial Sequence
  derived and/or modified CDS sequence (opt4) from PUUV(PUUV/Konnevesi/Mg_O6B/2005)__JQ319164.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagagccaucgugugcggccuguuccccacccagauccaggugagaaacaucaugagccccgugaugggcgugaucggcuucagcuucuucgugaaggacuggcccgagagaaucagagaguucaugggcaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5138 - RNA, 1302 nt, Artificial Sequence
  derived and/or modified CDS sequence (opt4) from PUUV(PUUV/Konnevesi/Mg_O74B/2005)__JQ319170.1__N
augagcgaccugaccgacauccaggaggacaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccguggaggagaagcugaagaagaagagcagcuucuaccagagcuaccugagaagaacccagagcaugggcauccagcuggaccagagaaucauccugcuguucaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5139 - RNA, 1302 nt, Artificial Sequence
  derived and/or modified CDS sequence (opt4) from PUUV(PUUV/Konnevesi/Mg_O78A/2005)__JQ319162.2__N
augagcgaccugaccgacauccaggaggacaucaccagacacgagcagcagcuggugguggccagacagaagcugaaggacgccgagaaggccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagaaggagugccccuucaucaagcccgaggugaagcccggcacccccgcccaggagaucgagaugcugaagagaaacaagaucuacuucaugcagagacaggacgugcuggacaagaaccacguggccgacaucgacaagcugaucgacuacgccgccagcggcgaccccaccagccccgacaacaucgacagccccaacgcccccugggugcuggccugcggccccgagagaugcccccccaccugcaucuacguggccggcauggccgagcugggcgccuucuucagcauccugcaggacaugagaaacaccaucauggccagcaagaccgugggcagcgacgaggugaagcugaagaagaagagcuucuucuaccaguacuaccugagaagaacccacagcaugggcauccagcuggaccagagaaucauccugcugugcaugcuggaguggggcaucgagaugguggaccacuuccaccugggcgacgacauggaccccgagcugagaggccuggcccaggccaugaucgaccagaaggugaaggagaucagcaaccaggagccccugaucaucuga

SEQ ID NO: 5140 - RNA, 1302 nt, Artificial Sequence
  derived and/or modified CDS sequence (opt4) from PUUV(PUUV/Mg23/HungaryTR17/00)__FN377822.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagaguucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5141 - RNA, 1302 nt, Artificial Sequence
  derived and/or modified CDS sequence (opt4) from PUUV(PUUV/Mg9/HungaryTR17/00)__FN377821.1__N
augagcgaccuggccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggagcgagagagugagagaguucauggagaaggagugccccuucaucaagcccgagaucaagcccggcacccccccccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5142 - RNA, 1302 nt, Artificial Sequence
  derived and/or modified CDS sequence (opt4) from PUUV(PUUV/NL/Mg1012/2010)__KU314900.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucagagaguucauggagaaggagugccccuucaucaagcccgaggugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcgccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5143 - RNA, 1302 nt, Artificial Sequence
  derived and/or modified CDS sequence (opt4) from PUUV(PUUV/NL/Mg1439/2011)__KU314901.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcgccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucagagaguucauggagagagagugccccuucaucaagcccgaggugaagcccggcacccccgcccaggaggccgaguuccugaagagaaacaagguguacuucaugcagagacaggacgugcuggacaagaaccacguggccgacaucgacgagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5144 - RNA, 1302 nt, Artificial Sequence
  derived and/or modified CDS sequence (opt4) from PUUV(PUUV/NL/Mg2/2008)__KU314902.1__N
augagcgaccugaccgacauccaggaggacaucaccagacacgagcagcagcuggugguggccagacagaagcugaaggacgccgagaaggccguggagauggaccccgacgacgugaacaagaccacccugcaggccagacagcagaccgugagcgcccuggaggacaagcuggccgacuucaagagacagauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgacgugaagcccggcacccccgcccaggaggccgaguuccugaagagaaacaagaucuacuucaugcagagacaggaggugcuggacaagaaccacguggccgacaucgacaagcugaucgacuacgccgccagcggcgaccccaccagccccgacaacaucgagagccccaacagccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaagguggaggagaucagcaaccaggagccccugaagaucuga

SEQ ID NO: 5145 - RNA, 1302 nt, Artificial Sequence
  derived and/or modified CDS sequence (opt4) from PUUV(PUUV/NL/Mg25/2007)__KU314897.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucagagaguucauggagaaggagugccccuucaucaagcccgaggugaagcccggcacccccgcccaggaggccgaguuccugaagagaaacaagguguacuucaugcagagacaggacgugcuggacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5146 - RNA, 1302 nt, Artificial Sequence
  derived and/or modified CDS sequence (opt4) from PUUV(PUUV/NL/Mg31/2007)__KU314896.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgacagaaucagagaguucauggagaaggagugccccuucaucaagcccgaggugaagcccggcacccccgcccaggaggccgaguuccugaagagaaacaagguguacuucaugcagagacaggacgugcccgacaagaaccacguggccgacaucgacaagcugaucgacuacgccgccagcggcgaccccaccagccccgacaacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5147 - RNA, 1302 nt, Artificial Sequence
  derived and/or modified CDS sequence (opt4) from PUUV(PUUV/NL/Mg502/2008)__KU314904.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgacgugaagcccggcacccccgcccaggaggccgaguuccugaagagaaacaagaucuacuucaugcagagacaggaggugcuggacaagaaccacguggccgacaucgacaagcugaucgacuacgccgccagcggcgaccccaccagccccgacaacaucgagagccccgacagccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5148 - RNA, 1302 nt, Artificial Sequence
  derived and/or modified CDS sequence (opt4) from PUUV(PUUV/NL/Mg591/2008)__KU314905.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgacgugaagcccggcacccccgcccaggaggccgaguuccugaagagaaacaagaucuacuucaugcagagacaggaggugcuggacaagaaccacguggccgacaucgacaagcugaucgacuacgccgccagcggcgaccccaccagccccgacaacaucgagagccccaacagccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5149 - RNA, 1302 nt, Artificial Sequence
  derived and/or modified CDS sequence (opt4) from PUUV(Samara_49/CG/2005)__AB433843.2__N
augagcgaccugaccgacauccaggaggagaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagaguucauggagagagagugccccuucaucaagcccgaggugaagcccggcacccccgcccaggagguggaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5150 - RNA, 1302 nt, Artificial Sequence
  derived and/or modified CDS sequence (opt4) from PUUV(Thuin/33Cg/96)__AJ277030.1__N
augagcgaccugaccgacauccaggaggacaucaccagacacgagcagcagcuggugguggccagacagaagcugaaggacgccgagaaggccguggagauggaccccgacgacgugaacaagaacacccugcaggccagacagcagaccgugagcgcccuggaggacaagcuggccgacuucaagagacagauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucagagaguucauggagaaggagugccccuucaucaagcccgaggugaagcccggcacccccgugcaggaggccgaguuccugaagagaaacaagaucuacuucaugcagagacaggaggugcuggacaagaaccacguggccgacaucgacaagcugaucgacuacgccgccagcggcgaccccaccagccccgacaacaucgaggcccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccaggcccugaucgaccagaaggugaaggagaucagcaaccaggagccccugaagaucuga

SEQ ID NO: 5151 - RNA, 1302 nt, Artificial Sequence
  derived and/or modified CDS sequence (opt4) from PUUV(Udmurtia/338Cg/92)__Z30708.1__N
augagcgaccugaccgacauccaggaggagaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacagcgugagcagaaagaagauggacaccaagcccaccgaccccaccggcaucgagcccgacgaccaccugaaggagagaagcagccccagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccaucaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagacuucauggagaaggagugccccuucaucaagcccgaggugaagcccggcacccccgcccaggagaucgaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5152 - RNA, 1302 nt, Artificial Sequence
  derived and/or modified CDS sequence (opt4) from PUUV(Udmurtia/444Cg/88)__Z30706.1__N
augagcgaccugaccgacauccaggaggagaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagacuucauggagaaggagugccccuucaucaagcccgaggugaagcccggcacccccgcccaggagaucgaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5153 - RNA, 1302 nt, Artificial Sequence
  derived and/or modified CDS sequence (opt4) from PUUV(Udmurtia/894Cg/91)__Z21497.1__N
augagcgaccugaccgacauccaggaggagaucaccagacacgagcagcagcuggugguggccagacagaagcugaaggacgccgagagagccguggagguggaccccgacgacgugaacaagaacacccugcaggccagacagcagaccgugagcgcccuggaggacaagcuggccgacuacaagagaagaauggccgacgccgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucaccauccccaucauccugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggcccgagagaaucagagacuucauggagaaggagugccccuucaucaagcccgaggugaagcccggcacccccgcccaggagaucgaguuccugaagagaaacagaguguacuucaugaccagacaggacgugcuggacaagaaccacguggccgacaucgacaagcugaucgacuacgccgccagcggcgaccccaccagccccgacgacaucgagagccccaacgcccccuggguguucgccugcgcccccgacagaugcccccccaccugcaucuacguggugggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaggccuggcccagagccugaucgaccagaaggugaaggagaucagcaaccaggagccccugaagaucuga

SEQ ID NO: 5154 - RNA, 1302 nt, Artificial Sequence
  derived and/or modified CDS sequence (opt4) from PUUV(Fusong-Cr-247)__EF442087.1__N
augagcgaccugaaggacauccaggaggacaucgccagacacgagcagcagcuggugguggccagacagaagcugagagacgccgagaaggccguggagauggaccccgacgacgugaacaacaacacccugcaggccagacagcagaccgugagcgcccuggaggacaagaucgccgacuucaagagaagaauggccgacaucgugagcagaaagaagauggacaccaagcccgccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucauccugaaggcccuguacaugcugagcaccagaggcagacagaccgugaaggagaacaagggcaccagaaucagauucaaggacgacaccagcuucgaggacgugaacggcaucagaagacccaagcaccuguacgugagcaugcccaccgcccagagcaccaugaaggccgaggagcugacccccggcagauucagaaccaucgugugcggccuguuccccacccagauccaggugagaaacaccaugagccccgugaugggcgugaucggcuucagcuucuucgccaaggacuggcccgacagaaucaaggaguucauggagaaggagugccccuucaucaagcccgaggugaagcccggcacccccgccaaggagguggagauccugaagagaaacaagaucuacuucaugcagagacaggacgugcuggacaagaaccacgugcccgacaucgacaagcugaucgacuacgccgccagcggcgaccccaccagccccgagaacaucgacagccccaacgcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaagccuggcccaggcccugaucgaccagaaggugaaggagaucagcaaccaggagccccugaagaucuga

SEQ ID NO: 5155 - RNA, 1302 nt, Artificial Sequence
  derived and/or modified CDS sequence (opt4) from MUV(11-4)__JX046484.1__N
augagcgaccugaaggagauccaggaggacaucgccagacacgagcagcagcuggugguggccagacagaagcugagagacgccgagaaggccguggagguggaccccgacgacgugaacaagaacacccugcaggccagacagcagaccgugagcgcccuggaggacaagcuggccgacuucaagagacagauggccgacuucgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucgugcugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucaaggaguucauggagaaggagugccccuucaucaagcccgagcccaagcccggcacccccgccagcgagguggaguuccugaagagaaacaagaucuacuucaugagcagacaggacgugcuggacaagaaccacgugcccgacaucgacaagcugaucgacuacgccgccagcggcgaccccaccagccccgacaacaucgaggaccccaacgcccccuggguguucagcugcgcccccgacagaugcccccccaccugccuguacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaacccuggcccaggcccugaucgaccagaaggugaaggagaucagcaaccaggagccccugaagaucuga

SEQ ID NO: 5156 - RNA, 1302 nt, Artificial Sequence
  derived and/or modified CDS sequence (opt4) from MUV(00-18)__DQ138128.1__N
augagcgaccugaaggagauccaggaggacaucgccagacacgagcagcagcuggugguggccagacagaagcugagagacgccgagaaggccguggagguggaccccgacgacgugaacaagaacacccugcaggccagacagcagaccgugagcgcccuggaggacaagcuggccgacuucaagagacagauggccgacuucgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucgugcugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggguggagagaaucaaggaguucauggagaaggagugccccuucaucaagcccgagcccaagcccggcacccccgccagcgagguggaguuccugaagagaaacaagaucuacuucaugaacagacaggacgugcuggacaagaaccacgugcccgacaucgacaagcugaucgacuacgccgccagcggcgaccccaccagccccgacaacaucgaggaccccaacgcccccuggguguucagcugcgcccccgacagaugcccccccaccugccuguacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaacccuggcccaggcccugaucgaccagaaggugaaggagaucagcaaccaggagccccugaagaucuga

SEQ ID NO: 5157 - RNA, 1302 nt, Artificial Sequence
  derived and/or modified CDS sequence (opt4) from MUV(11-1)__JX028273.1__N
augagcgaccugaaggagauccaggaggacaucgccagacacgagcagcagcuggugguggccagacagaagcugagagacgccgagaaggccguggagguggaccccgacgacgugaacaagaacacccugcaggccagacagcagaccgugagcgcccuggaggacaagcuggccgacuucaagagacagauggccgacuucgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacaucaucggcuucacccugcccaucgugcugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacugggccgacagaaucaaggaguucauggagaaggagugccccuucaucaagcccgagcccaagcccggcacccccgccagcgagaucgaguuccugaagagaaacaagaucuacuucaugagcagacaggacgugcuggacaagaaccacgugcccgacaucgacaagcugaucgacuacgccgccagcggcgaccccaccagccccgacaacaucgaggaccccaacgcccccuggguguucagcugcgcccccgacagaugcccccccaccugccuguacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaacccuggcccaggcccugaucgaccagaaggugaaggagaucagcaaccaggagccccugaagaucuga

SEQ ID NO: 5158 - RNA, 1302 nt, Artificial Sequence
  derived and/or modified CDS sequence (opt4) from MUV(96-1)__DQ138133.1__N
augagcgaccugaaggagauccaggaggacaucgccagacacgagcagcagcuggugguggccagacagaagcugagagacgccgagaaggccguggagguggaccccgacgacgugaacaagaacacccugcaggccagacagcagaccgugagcgcccuggaggacaagcuggccgacuucaagagacagauggccgacuucgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucgugcugaaggcccuguacaugcugagcaccagaggcagacagaccgugaaggagaacaagggcaccagaaucagauucaaggacgacaccagcuucgaggacaucaacggcaucagaagacccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucagauucagcuuccuggugaaggacuggagcgagaagaucaaggaguucauggagaaggagugccccuucaucaagcccgagcccaagcccggcacccccgccagcgagaucgaguuccugaagagaaacaagaucuacuucaugaacagacaggacgugcuggacaagaaccacgugcccgacaucgacaagcugaucgacuacgccgccagcggcgaccccaccagccccgacaacaucgaggcccccaacgcccccuggguguucagcugcgcccccgacagaugcccccccaccugccuguacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaacccuggcccaggcccugaucgaccagaaggugaaggagaucagcaaccaggagccccugaagaucuga

SEQ ID NO: 5159 - RNA, 1302 nt, Artificial Sequence
  derived and/or modified CDS sequence (opt4) from MUV(99-28)__DQ138142.1__N
augagcgaccugaaggagauccaggaggacaucgccagacacgagcagcagcuggugguggccagacagaagcugagagacgccgagaaggccguggagguggaccccgacgacgugaacaagaacacccugcaggccagacagcagaccgugagcgcccuggaggacaagcuggccgacuucaagagacagauggccgacuucgugagcagaaagaagauggacaccaagcccaccgaccccaccggcaucgagcccgacgaccaccugaaggagagaagcagccugagauacggcaacgugcuggacgugaacgccaucgacaucgaggagcccagcggccagaccgccgacugguacaccaucggcguguacgugaucggcuucacccugcccaucgugcugaaggcccuguacaugcugagcaccagaggcagacagaccgugaaggagaacaagggcaccagaaucagauucaaggacgacaccagcuucgaggacaucaacggcaucagaagccccaagcaccuguacgugagcaugcccaccgcccagagcaccaugaaggccgaggagcugacccccggcagauucagaaccaucgugugcggccuguuccccacccagauccaggugagaaacaucaugagccccgugaugggcgugaucggcuucagcuucuucgugaaggacuggguggagagaaucaaggaguucauggagaaggagugccccuucaucaagcccgagcccaagcccggcacccccgccagcgagguggaguuccugaagagaaacaagaucuacuucaugaacagacaggacgugcuggacaagaaccacgugcccgacaucgacaagcugaucgacuacgccgccagcggcgaccccaccagccccgacaacaucgaggaccccaacgcccccuggguguucagcugcgcccccgacagaugcccccccaccugccuguacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguacaugcuggaguggggcaaggagaugguggaccacuuccaccugggcgacgacauggaccccgagcugagaacccuggcccaggcccugaucgaccagaaggugaaggagaucagcaaccaggagccccugaagaucuga

SEQ ID NO: 5160 - RNA, 1290 nt, Artificial Sequence
  derived and/or modified CDS sequence (opt4) from SANGV(SA14)__NC_034526.1__N
auggccacccuggaggagauccagaaggagaucaacauccacgagggccagcugaucaucgccaagcagaaggugaaggacgccgagaagcaguacgagaaggaccccgacgaccugaacaagagagcccugagcgacagagagggcaucgcccacagcauccagagcaagaucgacgagcugagaagacagcuggccgacagaguggccgccggcagaaaccugggccaggagagagaccccaccggcguggagcccggcgaccaccugagagagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgaggagaucacccccggcagauucagaaccgccgugugcggccuguaccccgcccagaucaaggccagaaacauggugagccccgugaugagcgugaucggcuucaucacccuggccagagacuggaccgagagaaucgagaacuggcuggaccagcccugcaaguucaugagcgagcccagccagaccagccugcagaagggccccgccaccaacagagacuaccugaaccagagacaggccagccuggcccagauggagaccaaggaggcccaggccgugagacagcaggccguggacgccggcugcaaccugguggaccacaucgacagccccagcagcaucuggguguucgccggcgcccccgacagaugcccccccaccugccuguucaucagcggcauggccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucaucauguucaugguggaguggggcaaggaggccguggacggcuuccaccugggcgacgacauggaccccgagcugagaagcuucgcccaggcccugaucgaccagaaggugaaggagaucagcaaccaggagccccugaagaucuga

SEQ ID NO: 5161 - RNA, 1290 nt, Artificial Sequence
  derived and/or modified CDS sequence (opt4) from SANGV(SA22)__JQ082303.1__N
auggccacccuggaggagauccagaaggagaucaacauccacgagggccagcugaucaucgccaagcagaaggugaaggacgccgagaagcaguacgagaaggaccccgacgaccugaacaagagagcccugagcgacagagagggcaucgcccacagcauccagagcaagaucgacgagcugagaagacagcuggccgacagaguggccgccggcagaaaccugggccaggagagagaccccaccggcguggagcccggcgaccaccugagagagaagagcaugcugagcuacggcaacgugaucgaccugaaccaccuggacaucgacgagcccaccggccagaccgccgacuggcugagcaucgugaucuaccugaccagcuucguggugcccauccugcugaaggcccuguacaugcugaccaccagaggcagacagaccaccaaggacaacaagggcaugagaaucagauucaaggacgacagcagcuucgaggacgugaacggcaucagaaagcccaagcaccuguuccugagcaugcccaacgcccagagcagcaugaaggccgaggagaucacccccggcagauucagaaccgccgugugcggccuguaccccgcccagaucaaggccagaaacauggugagccccgugaugagcgugaucggcuucaucacccuggccagagacuggaccgagagaaucgagaacuggcuggaccagcccugcaaguucaugagcgagcccagccagaccagccugcagaagggccccgccaccaacagagacuaccugaaccagagacaggccagccuggcccagauggagaccaaggaggcccaggccgugagacagcaggccguggacgccggcugcaaccugguggaccacaucgacagccccagcagcaucuggguguucgccggcgcccccgacagaugcccccccaccugccuguucaucagcggcauggccgagcugggcgccuucuucagcauccugcaggacaugagaaacaccaucauggccagcaagaccgugggcaccagcgaggagaagcugagaaagaagagcagcuucuaccagagcuaccugagaagaacccagagcaugggcauccagcuggaccagagaaucaucaucauguucaugguggaguggggcaaggaggugguggacggcuuccaccugggcgacgacauggaccccgagcugagaagcuucgcccaggcccugaucgaccagaaggugaaggagaucagcaaccaggagccccugaagaucuga

SEQ ID NO: 5162 - RNA, 1290 nt, Artificial Sequence
  derived and/or modified CDS sequence (opt4) from SEOV(L99)__AF288299.1__N
auggccaccauggaggagauccagagagagaucagcgcccacgagggccagcuggugaucgccagacagaaggugaaggacgccgagaagcaguacgagaaggaccccgacgaccugaacaagagaacccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguguacaacuuccaccugggcgacgacauggaccccgagcugagaagccuggcccagauccugaucgaccagaaggugaaggagaucagcaaccaggagcccaugaagcuguga

SEQ ID NO: 5163 - RNA, 1290 nt, Artificial Sequence
  derived and/or modified CDS sequence (opt4) from SEOV(SG42/2011)__KY807171.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggagcaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggagcagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5164 - RNA, 1290 nt, Artificial Sequence
  derived and/or modified CDS sequence (opt4) from SEOV(XJ2/2011)__KY807169.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaagcagacagaccagcaaggacaacaagggcaugagaaucagauucaaggacgacagcagcuacgaggacgugaacggcaucagaaagcccaagcaccuguacgugagcaugcccaacgcccagagcagcaugagagccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcugggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5165 - RNA, 1290 nt, Artificial Sequence
  derived and/or modified CDS sequence (opt4) from SEOV(XJ5/2011)__KY807170.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcaccccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugagcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5166 - RNA, 1290 nt, Artificial Sequence
  derived and/or modified CDS sequence (opt4) from SEOV(10-134)__JF693882.2__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucgugcugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5167 - RNA, 1290 nt, Artificial Sequence
  derived and/or modified CDS sequence (opt4) from SEOV(DPRK08)__JX853575.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5168 - RNA, 1290 nt, Artificial Sequence
  derived and/or modified CDS sequence (opt4) from SEOV(Fj372/2013)__KP645198.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcagccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5169 - RNA, 1290 nt, Artificial Sequence
  derived and/or modified CDS sequence (opt4) from SEOV(HeB38)__JN377553.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugaagaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagccccuucuaccagagcuaccugagaagaacccagagcaugggcauccagcuggaccagagaaucaucgugauguucaugguggccuggggcaaggaggccguggacaacuuccaccugggcgacgacauggaccccgagcugagaggccuggcccagauccugaucgaccagaaggugaaggagaucagcaaccaggagcccaugaagcuguga

SEQ ID NO: 5170 - RNA, 1290 nt, Artificial Sequence
  derived and/or modified CDS sequence (opt4) from SEOV(JiangxiXinjianRn-07-2011)__KP859511.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5171 - RNA, 1290 nt, Artificial Sequence
  derived and/or modified CDS sequence (opt4) from SEOV(JiangxiXinjianRn-09-2011)__KP859512.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccaguucagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5172 - RNA, 1290 nt, Artificial Sequence
  derived and/or modified CDS sequence (opt4) from SEOV(Singapore/06(RN41))__GQ274944.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaggccuggcccagauccugaucgaccagaaggugaaggagaucagcaaccaggagcccaugaagcuguga

SEQ ID NO: 5173 - RNA, 1290 nt, Artificial Sequence
  derived and/or modified CDS sequence (opt4) from SEOV(YaluRiver12)__HQ611980.1__N
auggccaccauggaggagauccagagagagaucagcgcccacgagggccagcuggugaucgccagacagaaggugaaggacgccgagaagcaguacgagaaggaccccggcgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacagcaagggcaugagaaucagauucaaggacgacagcagcuacgaggacgugaacggcaucagaaagcccaagcaccuguacgugagcaugcccaacgcccagagcagcaugaagaccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcgagaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5174 - RNA, 1290 nt, Artificial Sequence
  derived and/or modified CDS sequence (opt4) from SEOV(14D12)__AB618124.1__N
auggccaccauggaggagauccagaaggagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5175 - RNA, 1281 nt, Artificial Sequence
  derived and/or modified CDS sequence (opt4) from SEOV(19CSG)__AB618114.1__N
auggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5176 - RNA, 1290 nt, Artificial Sequence
  derived and/or modified CDS sequence (opt4) from SEOV(93HBX12)__EF192308.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucggcaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaggccuggcccagauccugaucgaccagaaggugaaggagaucagcaaccaggagcccaugaagcuguga

SEQ ID NO: 5177 - RNA, 1290 nt, Artificial Sequence
  derived and/or modified CDS sequence (opt4) from SEOV(Cherwell)__KC626089.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucaucgccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5178 - RNA, 1290 nt, Artificial Sequence
  derived and/or modified CDS sequence (opt4) from SEOV(CixiRf23)__FJ803201.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcagaacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5179 - RNA, 1290 nt, Artificial Sequence
  derived and/or modified CDS sequence (opt4) from SEOV(CixiRf56)__FJ803202.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagggccagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuucccccuggugcacgacauggaccccaagcugagaagccugagccagauccugaucgaccagaaggugaacgagaucagcaaccaggagcccaugaagcuguga

SEQ ID NO: 5180 - RNA, 1290 nt, Artificial Sequence
  derived and/or modified CDS sequence (opt4) from SEOV(CixiRn21)__FJ803205.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggacgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccacagaaucaucgugauguucaugguggccuggggcaaggaggccguggacaacuuccaccugggcgacgacauggaccccgagcugagaacccuggcccagauccugaucgaccagaaggugaaggagaucagcaaccaggagcccaugaagcuguga

SEQ ID NO: 5181 - RNA, 1290 nt, Artificial Sequence
  derived and/or modified CDS sequence (opt4) from SEOV(CixiRn76)__FJ803206.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcagccagaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagggccagggcgcccuggccggcauggagcccaaggaguuccaggcccugagacagcacgccaaggacgccggcugcacccugguggagcacaucgagagccccagcagcaucuggguguucgccggcgccagagacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5182 - RNA, 1290 nt, Artificial Sequence
  derived and/or modified CDS sequence (opt4) from SEOV(CUI)__GQ279395.1__N
auggccaccauggaggagcugcagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacaugcugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacaagaagcugagaaagaagagcagcuucuaccagagcuaccugagaagaacccagagcaugggcauccagcuggaccagagaaucaucgugauguucauguucgccuggggcaaggaggccguggacaacuuccaccugggcgacgacauggaccccgagcugagaggccuggcccagauccugaucgaccagaaggugaaggagaucagcaaccaggagcccaugaagcuguga

SEQ ID NO: 5183 - RNA, 1290 nt, Artificial Sequence
  derived and/or modified CDS sequence (opt4) from SEOV(FeixianRn1)__GU592942.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucaccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5184 - RNA, 1290 nt, Artificial Sequence
  derived and/or modified CDS sequence (opt4) from SEOV(GanyuRn66)__GU592932.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucaccgccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5185 - RNA, 1290 nt, Artificial Sequence
  derived and/or modified CDS sequence (opt4) from SEOV(Gongzhuling108)__KF745947.1__N
auggccaccauggaggagauccagagagagaucagcgcccacgagggccagcuggugaucgccagacagaaggugaaggacgccgagaagcaguacgagaaggaccccgacgaccugaacaagagcgcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccauccugguguaccugaccagcuucguggugcccaucauccugaaggcccuguacaugcugaccaccagaggcagacagaccagcaaggacaacaagggcaugagaaucagauucaaggacgacggcagcuacgaggacgugaacggcaucagaaagcccaagcaccuguacgugcccaugcccaacgcccagagcagcaugaaggccgaggagaucacccccggcagauucagaaccgccgugugcggccuguaccccgcccagaucaagcccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucagaguguucgccggcgcccccgccagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaagccagagcaugggcauccagcuggaccagagaaucaucgugauguucaugguggccagcggcaaggaggccguggacaacuuccaccugggcgacgacauggaccccgagcugagaagccuggugcagauccugaucgaccagaaggugaaggagaucagcaaccaggagcccaugaagcuguga

SEQ ID NO: 5186 - RNA, 1290 nt, Artificial Sequence
  derived and/or modified CDS sequence (opt4) from SEOV(Gongzhuling147)__KF745948.1__N
auggccaccauggaggagauccagagagagaucagcgcccacgagggccagcuggugaucgccagacagaucgugaaggacgccgagaagcaguacgagaaggaccccgccgaccugaacaagagagcccugcacgacagagagagcguggccgccagcauccagagcaagaucgacgagcugaagagacaccuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacauccugaccaccagcggcagacagaccagcaaggacaacaagggcaugagaaucagauucaaggacgacagcagcuacgaggacgugaacggcaucagaaugcccaagcaccuguacgugcccaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugcccccccaccugccuguucgugggcggcauggccgagcugggcgccuucuucaccauccugcaggacaugagaaacaccaucaugcccagcaagaccgugggcaccgccgacgagaagcugagaaagaagagcagcuucuaccagagcuaccugagaagaacccagagcaugggcauccagcuggaccagagaaucaucgugaucuucaugguggccugggccaaggaggccguggacaacuuccaccugggcgacgacauggaccccgagcugagaagccuggcccagauccugaucgaccagaaggugaaggagaucagcaaccaggugcccaugaagcuguga

SEQ ID NO: 5187 - RNA, 1290 nt, Artificial Sequence
  derived and/or modified CDS sequence (opt4) from SEOV(Gongzhuling415)__KF745949.1__N
auggccaccauggaggagauccagagagagaucagcgcccacgagggccagcuggugaucgccagacagauggugaaggacgccgagaagcaguacgagaaggaccuggccgaccugaacaagagagcccugcacgacagagagagcguggccgccagcauccagagcaagaucgacgagcugaagagacagcuggccgacagaaucgccgccggcaagaacaucgagcaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacauccugaccaccagaggcagacagaccagcaaggacaacaagggcaugaccaucagauucaaggacgacagcagcuacgaggacgugaacggcaucagaaugcccaagcaccuguacgugcccaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugccugcccaccugccuguucgugggcggcauggccgagcugggcgccuucuucaccauccugcaggacaugagaaacaccaucauggccagcaagaccgugggcaccgccgacgagaagcugggcaagaagagcagcuucuaccagagcuaccugagaagaacccagagcaugggcauccagcuggaccagagaaucaucgugauguucaugguggccugggccaaggaggccguggacaacauccaccugggcgacgacauggaccccgagcugagaagccuggcccagauccugaucgaccagaaggugaaggagaucagcaaccaggugcccaugaagcuguga

SEQ ID NO: 5188 - RNA, 1290 nt, Artificial Sequence
  derived and/or modified CDS sequence (opt4) from SEOV(Gongzhuling42)__KF745942.1__N
auggccaccauggaggagauccagagagagaucagcgcccacgagggccagcuggugaucgccagacagaaggugaaggacgcccagaagcaguacgagaaggaccccgacgaccugaacaagagagcccugcacgacagagagagcguggccgccagcauccagcugaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaagggcaucagaaagcccaagcaccuguacgugcccaugcccaacgcccagagcagcaugaaggccgaggagaucacccccggcagaugcagaaccgccgugugcggccuguaccccgcccagaucaaggccagaaacauggugagccccgugaugagcgccgugggcauccuggcccuggccaaggacuggaccagcagaaucgaggaguggcugggcacccccugcaaguucauggccgagagccccaucgccggcagccugagcggcaaccccgugaacagagaccacaucagacagagacagggcgcccuggccggcauggagcccaaggaguuccagggccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucgccauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccugggccaaggaggccguggacaacuuccaccugggcgacgacauggaccccgagcugagaagccuggcccagauccugauggaccagaaggugaaggagaucagcaaccaggagcccaugaagcuguga

SEQ ID NO: 5189 - RNA, 1290 nt, Artificial Sequence
  derived and/or modified CDS sequence (opt4) from SEOV(Gongzhuling45)__KF745943.1__N
auggccaccauggaggagauccagagagagaucagcgcccacgagggccagcuggugaucgccagacagauggugaaggacgccgagaagcaguacgagaaggaccccgccgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacagaaacacccuggaccugaacagccuggacaucgacgagcccaccggccagaccgccgacuggcugaccaucaucguguaccugaccagcuucguggugcccaucauccugaaggcccuguacauccugaccaccagaggcagacagaccagcaaggacaacaagggcaugagaaucagauucaaggacgacagcagcuacgaggacgugaacggcaucagaaugcccaagcaccuguaccugcccaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugcccccccaccugccuguucgugggcggcauggccgagcugggcgccuucuucaccauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccugggccaaggaggccguggacaacuuccaccugggcgacgacauggaccccgagcugagaagccuggcccagauccugaucgaccacaaggugaaggagaucagcaaccaggugcccaugaagcuguga

SEQ ID NO: 5190 - RNA, 1290 nt, Artificial Sequence
  derived and/or modified CDS sequence (opt4) from SEOV(Gongzhuling58)__KF745944.1__N
auggccaccauggaggagauccagagagagaucagcgcccacgagggccagcuggugaucgccagacagauggugaaggacgccgagaagcaguacgagaaggaccccgccgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacauccugaccaccagaggcagacagaccagcaaggacaacaagggcaugagaaucagauucaaggacgacagcagcuacgaggacgugaacggcaucagaaugcccaagcaccuguacgugcccaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugcccccccaccugccuguucgugggcggcauggccgagcugggcgccuucuucaccauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccugggccaaggaggccguggacaacuuccaccugggcgacgacauggaccccgagcugagaagccuggcccagauccugaucgaccagaaggugaaggagaucagcaaccaggugcccaugaagcuguga

SEQ ID NO: 5191 - RNA, 1290 nt, Artificial Sequence
  derived and/or modified CDS sequence (opt4) from SEOV(Gongzhuling85)__KF745945.1__N
auggccaccauggaggagauccagagagagaucagcgcccacgagggccagcuggugaucgccagacagauggugaaggacgccgagaagcaguacgagaaggaccccgccgaccugaucaagagagcccugcacgacagagagagcguggccgccagcauccagagcaagaucgacgagcugaagagacagcuggccgacagaaucgccgccggcaagaacaucggccaggacagagaccccaccggccuggagcccggcgaccaccugaaggagagaagcgcccugagcuacggcaacacccuggaccugaacagccuggacaucgacgagcccaccggccagaccgccgacuggcugaccgugaucguguaccugaccagcuucguggugcccaucauccugaaggcccuguacauccugaccaccagaggcagacagaccagcaaggacaacaagggcaugagaaucagauucaaggacgugagcagcuacgaggacgugaacggcaucagaaugcccaagcaccuguacgugcccaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugcccccccaccugccuguucgugagaggcauggccgagcugggcgccuucuucaccauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccugggccaaggaggccguggacaacuuccaccugggcgacgacaugcaccccgagcugagaagccuggcccagauccugaucgaccagaaggugaaggagaucagcaaccaggugcccaugaagcuguga

SEQ ID NO: 5192 - RNA, 1290 nt, Artificial Sequence
  derived and/or modified CDS sequence (opt4) from SEOV(Gongzhuling97)__KF745946.1__N
auggccaccauggaggagauccagagagagaucagcgcccacgagggccagcuggugaucgccagacagauggugaaggacgccgagaagcaguacgagaaggaccccgccgaccugaacaagagagcccugcacgacagagagagcguggccgccagcauccagagcaagaucgacgaccugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaugcccaagcaccuguacgugagaaugcccaacgcccagagcagcaugaaggccgaggacaucacccccggcagauucagaaccgccgugugcggccuguaccccgcccagaucaaggccagaaacauggugagcccccugaugagcguggugggcuuccuggcccugcccaaggacuggaccagcagaaucgacgaguggcugggcgcccccugcaaguucauggccgagagccccaucgccggcagccugagcggcaaccccgugaacagagaccacaucagacagagacagggcgcccuggccggcauggaccccaaggaguuccaggccgugagacagcacgccaaggacgccggcugcacccugguggagcacaucgagagccccagcagcaucuggguguucgccggcgcccccgacagaugcccccccaccugccuguucgugggcggcauggccgagcugggcgccuucuucaccauccugcaggacaugagaaucaccaucauggccagcaagaccgugggcaccgccgacgagaagcugagaaagaagagcagcuucuaccagagcuaccugagaagaacccagagcaugggcauccagcuggaccagagacugaucgugauguucaugguggccugggccaaggaggccguggacaacuuccaccugggcgacgacauggaccccgagcugagaagccuggcccagauccugaucgaccagaaggugaagcagaucagcaaccaggugcccaugaagcuguga

SEQ ID NO: 5193 - RNA, 1290 nt, Artificial Sequence
  derived and/or modified CDS sequence (opt4) from SEOV(Gou3)__AB027522.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagcuucagaaccgccgugugcggccuguaccccgccaccaucaaggccagaaacauggugagccccgugaugagcguggugggcuuccuggcccuggccaaggacuggaccagcagaaucgaggacuggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcaccaugguggagcagaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5194 - RNA, 1290 nt, Artificial Sequence
  derived and/or modified CDS sequence (opt4) from SEOV(Hb8610)__AF288643.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagagcaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaagaaggccguggacaacuuccaccugggcgacgacauggaccccgagcugagaagccuggcccagauccugaucgaccagaaggugaaggagaucagcaaccaggagcccaugaagcuguga

SEQ ID NO: 5195 - RNA, 1290 nt, Artificial Sequence
  derived and/or modified CDS sequence (opt4) from SEOV(HuBJ16)__GQ279380.1__N
auggccaccauggaggagauccagagagagaucagcgcccacgagggccagcuggugaucgccagacagaaggugaagaacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcacccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5196 - RNA, 1290 nt, Artificial Sequence
  derived and/or modified CDS sequence (opt4) from SEOV(HuBJ22)__GQ279379.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcacccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5197 - RNA, 1290 nt, Artificial Sequence
  derived and/or modified CDS sequence (opt4) from SEOV(HuBJ3)__GQ279391.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggugaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcagauucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgagggcugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5198 - RNA, 1290 nt, Artificial Sequence
  derived and/or modified CDS sequence (opt4) from SEOV(K24-e7)__AF288653.1__N
auggccaccauggaggagauccagagagagaucagcgcccacgagggccagcuggugaucgccagacagaaggugaaggacgccgagaagcaguacgagaaggaccccgacgacuucaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5199 - RNA, 1290 nt, Artificial Sequence
  derived and/or modified CDS sequence (opt4) from SEOV(K24-v2)__AF288655.1__N
auggccaccauggaggagauccagagagagaucagcgcccacgagggccagcuggugaucgccagacagaaggugaaggacgccgagaagcaguacgagaaggaccccgacgacuucaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagacacacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5200 - RNA, 1290 nt, Artificial Sequence
  derived and/or modified CDS sequence (opt4) from SEOV(OuhaiRf35)__FJ803208.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgccagagacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5201 - RNA, 1290 nt, Artificial Sequence
  derived and/or modified CDS sequence (opt4) from SEOV(OuhaiRn146)__FJ803210.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagggccagggcgcccuggccggcauggagcccaaggaguuccaggcccugagacagcacgccaaggacgccggcugcacccugguggagcacaucgagagccccagcagcaucuggguguucgccggcgccagagacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5202 - RNA, 1290 nt, Artificial Sequence
  derived and/or modified CDS sequence (opt4) from SEOV(Pf26)__AY006465.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcgugcagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaagcccagaaacauggugagccccgugaucagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5203 - RNA, 1290 nt, Artificial Sequence
  derived and/or modified CDS sequence (opt4) from SEOV(Rn-CP7)__GQ279382.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaagcauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5204 - RNA, 1290 nt, Artificial Sequence
  derived and/or modified CDS sequence (opt4) from SEOV(Rn-DC8)__GQ279386.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccgccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaagcauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5205 - RNA, 1290 nt, Artificial Sequence
  derived and/or modified CDS sequence (opt4) from SEOV(Rn-M11)__GQ279383.1__N
auggccaccauggaggagauccagagagagaucagcgcccacgagggccagcuggugaucgccagacagaaggugaagaacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaagcauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagaagaggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5206 - RNA, 1290 nt, Artificial Sequence
  derived and/or modified CDS sequence (opt4) from SEOV(RuianRf74)__FJ803213.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaauggccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacaucgaccccgagcugagaagccuggcccagauccugaucgaccagaaggugaaggagaucagcaaccaggagcccaugaagcuguga

SEQ ID NO: 5207 - RNA, 1290 nt, Artificial Sequence
  derived and/or modified CDS sequence (opt4) from SEOV(RuianRn23)__FJ803214.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucaaggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5208 - RNA, 1290 nt, Artificial Sequence
  derived and/or modified CDS sequence (opt4) from SEOV(RuianRn33)__FJ803215.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccagaggcaaggaggccauguacaaccugcaccugagagacgacaugaccccccagcugcugcugcuggugcagauccugcuggaccaccaggugaaggagaucagcaaccaggagcugaugaagcuguga

SEQ ID NO: 5209 - RNA, 1290 nt, Artificial Sequence
  derived and/or modified CDS sequence (opt4) from SEOV(SC106)__GU361893.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugcccaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5210 - RNA, 1290 nt, Artificial Sequence
  derived and/or modified CDS sequence (opt4) from SEOV(SEO/Belgium/Rn895/2005)__JQ898106.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgacagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5211 - RNA, 1290 nt, Artificial Sequence
  derived and/or modified CDS sequence (opt4) from SEOV(Taonan420)__KF745951.1__N
auggccaccauggaggagauccagagagagaucagcgcccacgagggccagcuggugaucgccagacagaacgugaaggacgccgagaagcaguacgagaaggaccccgacgaccugaacaagagagcccugcacgacagagagagcguggccgccagcauccagagcaagaucgacgagcugaagagacagcccgccgacagaaucgccgccggcaagaacaucggccaggacagagaccccaccggcguggagcccggcgaccaccugaaggagagaagcgcccugagcuacggcaacacccuggaccugaacagacuggacaucgacgagcccaccggccagagagccgacuggcugaccaucaucguguaccugaccagcuucguggugagaaucauccugaaggcccuguacauguucagcaccagaggcagacagaccagcaaggacaacaagggccugagaaucagauucaaggacgacagcagcuacgaggacuucaacggcaucagaaagcccaagcaccuguacgugcccaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccgccauggagcccaaggaguuccaggcccugagacagcacgccaaggaccccggcugcacccugguggagcacaucgagagccccagcagcaucugggugagcgccggcgcccccgacagaugcccccccaccugccuguucgugggcggcauggccgagcugggcgccuucuucagcaucuuccaggacaugagaaacaccaucaugcccagcaagaccgugggcaccgccgacgagaagcugagaaagaagagccuguucuaccagagcuaccugagaagaacccagagcaugggcauccagcuggaccagagaaucaucgugauguucaugguggccuggggcaaggaggccguggacaacuuccaccugcccgacgacauggaccccgagcugagaagccuggcccagauccugaucgugcagaaggugaaggagaucagcaaccaggagcccaugaagcuguga

SEQ ID NO: 5212 - RNA, 1290 nt, Artificial Sequence
  derived and/or modified CDS sequence (opt4) from SEOV(Taonan52)__KF745950.1__N
auggccaccauggaggagauccagagagagaucagcgcccacgagggccagcuggugaccgccagacagaaggugaaggacgccgagaagcaguacgagaaggaccccgacgaccugaacaagagagcccugcacgacagagagagcguggccgccagcauccagagcaagaucgacgaggugaagagacagcuggccgacagaaucgccgccggcaagaacaucggccaggacagagaccccaccggcguggagcccggcgaccaccccaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugagcaccaccagaggcagacagaccagcaaggacaacagaggcaugagaaucagauuccaggacgacagcagcuacgaggacgugaacggcaucagaaagcccaagcaccuguacgugcccaugcccaacgcccagagcagcaugaaggccgaggaggugacccccggcagauucagaaccgccgugugcggccuguaccccgcccagaucaaggccagaaacauggugagacccgugaugagcguggugggcuuccuggcccuggccaaggccuggaccagcagaaucgaggaguggcugggcgcccccugcaaguucauggccgagagccccaucgccggcagccugagcggcaaccccguguacagagacuacaucagacagagacagggcgcccuggccggcauggagcccaaggaguuccaggcccugagacagcacgccaaggacgccggcugcacccugguggagcugaucgagagccccagcagcaucagcguguucgccggcgcccccgacagaugccccagaaccugccuguucgugggcggcauggccgagcugggcgccaacuucagcaugcugcaggacaugagcaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccagcggcaaggaggccguggacuacuuccaccugggcgacgacauggaccccgagcugagaagccuggcccccauccugaucgaccagaaggugaaggagaucagcaaccaggagcccaugaagcuguga

SEQ ID NO: 5213 - RNA, 1290 nt, Artificial Sequence
  derived and/or modified CDS sequence (opt4) from SEOV(WuhanMm24)__JQ665911.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcgccgccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccggccugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5214 - RNA, 1290 nt, Artificial Sequence
  derived and/or modified CDS sequence (opt4) from SEOV(WuhanRf02)__JQ665912.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccuggaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagagacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgccagagacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5215 - RNA, 1290 nt, Artificial Sequence
  derived and/or modified CDS sequence (opt4) from SEOV(WuhanRf07)__JQ665913.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgccagagacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5216 - RNA, 1290 nt, Artificial Sequence
  derived and/or modified CDS sequence (opt4) from SEOV(ZJ5)__FJ753400.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccuggugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaucguggccuggggcaaggaggccguggacaacuuccaccugggcgacgaccuggaccccgagcugagaagccuggcccagauccugaucgaccagaaggugaaggagaucagcaaccaggagcccaugaagcuguga

SEQ ID NO: 5217 - RNA, 1290 nt, Artificial Sequence
  derived and/or modified CDS sequence (opt4) from SEOV(ZT10)__AY766368.1__N
auggcccugugcgaggagauccagagagagaucagcgcccacgagggccagcuggugaucgccagacagaaggugaaggacgccgagaagcaguacgagaaggaccccgacgacuucaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcggccuggccgacaugagaaacaccaucauggccagcaagaccgagggcaccgccgacgagaagcugagaaagaagagcagcuucuaccagagcuaccugagaagacagcagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5218 - RNA, 1290 nt, Artificial Sequence
  derived and/or modified CDS sequence (opt4) from SEOV(ZT71)__AY750171.1__N
auggccaccauggaggagauccagagagagaucagcgcccacgagggccagcuggugaucgccagacagaaggugaaggacgccgagaagcaguacgagaaggaccccgacgacuucaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgagggcaccgccgacgagaagcugagaaagaagagcagcuucuaccagagcuaccugagaagacagcagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5219 - RNA, 1290 nt, Artificial Sequence
  derived and/or modified CDS sequence (opt4) from SEOV(zy27)__AF406965.1__N
auggccaccauggaggagauccagagagagaucagcgcccacgagggccagcuggugaucgccagacagaaggugaaggacgccgagaagcaguacgagaaggaccccgacgacagcaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccccagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccgagagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagaccacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5220 - RNA, 1290 nt, Artificial Sequence
  derived and/or modified CDS sequence (opt4) from SEOV(DN2)__KX289954.1__N
auggccaccauggaggagauccagagagagaucagcgcccacgagggccagcuggugaucgccagacagaaggccaaggacgccgagaagcaguacgagaaggaccccgacgaccugaacaagagagcccugcacgacagaggcagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgagcccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcguguucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5221 - RNA, 1290 nt, Artificial Sequence
  derived and/or modified CDS sequence (opt4) from SEOV(IR162)__KX079476.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcuggacacccccugcaaguucaugguggagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5222 - RNA, 1290 nt, Artificial Sequence
  derived and/or modified CDS sequence (opt4) from SEOV(Gou3)__AF184988.1__N
auggccaccauggaggagauccagagagagaucagcgcccacgagggccagcuggugaucgccagaagaaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggacuggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucuucauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5223 - RNA, 1290 nt, Artificial Sequence
  derived and/or modified CDS sequence (opt4) from SEOV(Gou3-v9)__AF288651.1__N
auggccaccaaggaggagauccagagagagaucagcgcccacgagggccagcuggugaucgccagacagaaggugaaggacgccgagaagcaguacgagaaggaccccgacgugcugaacaagagagcccugcacgacagagagagcguggccgccagcauccagagcaagaucgacgagcugaagagacagcuggccgacagaaucgccgccggcaagagcaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacagaggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggacuggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5224 - RNA, 1290 nt, Artificial Sequence
  derived and/or modified CDS sequence (opt4) from SEOV(IR461)__AF329388.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaucagaaucagauucaaggacgacagcagcuacgagaacgugaacggcaucagaaagcccaagcaccuguacgugagcaugcccaacgcccagagcagcaugaaggccgaggagaucacccccggcagauucagaaccgccgugugcggccuguaccccgcccagaucaaggccggcaacauggugagccccgugaugagcguggugggcuuccuggcccuggccaaggacuggaccagcagaaucgaggaguggcuggacacccccugcaaguucaugguggagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5225 - RNA, 1290 nt, Artificial Sequence
  derived and/or modified CDS sequence (opt4) from SEOV(JUN5-14)__DQ217791.1__N
auggccaccauggaggaguuccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5226 - RNA, 1290 nt, Artificial Sequence
  derived and/or modified CDS sequence (opt4) from SEOV(L99)__AF488708.1__N
auggccaccauggaggagauccagagagagaucagcgcccacgagggccagcuggugaucgccagacagaaggugaaggacgccgagaagcaguacgagaaggaccccgacgaccugaacaagagaacccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5227 - RNA, 1290 nt, Artificial Sequence
  derived and/or modified CDS sequence (opt4) from SEOV(R22)__AF488707.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcagaauggccgagcugggcgccuucuucagcauccugcaggacaugaagaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5228 - RNA, 1290 nt, Artificial Sequence
  derived and/or modified CDS sequence (opt4) from SEOV(TURCKHEIM/Hu/FRA/2016/2016.00044)__KX064270.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcuggacgcccccugcaaguucaucgccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5229 - RNA, 1290 nt, Artificial Sequence
  derived and/or modified CDS sequence (opt4) from SEOV(Z37)__AF187082.1__N
auggccaccauggaggagauccagagagagaucagcgcccacgagggccagcuggugaucgccagacagaaggugaaggacgccgagaagcaguacgagaaggaccccgacgacuucaacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacgccaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucggcauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5230 - RNA, 1290 nt, Artificial Sequence
  derived and/or modified CDS sequence (opt4) from SEOV(Tchoupitoulas (TCH))__AF329389.1__N
auggccaccauggaggagauccagagagagaucagcgcccacgagggccagcuggugaucgccagacagaaggugaaggacgccgagaagcaguacgagaaggaccccgacgacuucuacaagagagcccugcacgacagagagagcguggccgccagcauccagagcaagaucgacgagcugaagagacagcuggccgacagaaucgccgccggcaagaacaucggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccccaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5231 - RNA, 1290 nt, Artificial Sequence
  derived and/or modified CDS sequence (opt4) from SEOV__M34881.1__N
auggccaccauggaggagauccagagagagaucagcgcccacgagggccagcuggugaucgccagacagaaggugaaggacgccgagaagcaguacgagaaggaccccgacgaccugaacaagagagcccugcacgacagagagagcguggccgccagcauccagagcaagaucgacgagcugaagagacagcuggccgacagacugcagcagggcagaaccagcggccaggacagagaccccaccggcguggagcccggcgaccaccugaaggagagaagcgcccugagcuacggcaacacccuggaccugaacagccuggacaucgacgagcccaccggccagaccgccgacuggcugaccaucaucguguaccugaccagcuucguggugcccaucauccugaaggcccuguacaugcugaccaccagaggcagacagaccagcaaggacaacaagggcaugagaaucagauucaaggacgacagcagcuacgaggacgugaacggcaucagaaagcccaagcaccuguacgugagcaugcccaacgcccagagcagcaugaaggccgaggagaucacccccggcagauucagaaccgccgugugcggccuguaccccgcccagaucaaggccagaaacauggugagccccgugaugagcguggugggcuuccuggcccuggccaaggacuggaccagcagaaucgaggaguggcugggcgcccccugcaaguucauggccgagagccugaucgccggcagccugagcggcaaccccgugaacagagacuacaucagacagagacagggcgcccuggccggcauggagcccaaggaguuccaggcccugagacagcacagcaaggacgccggcugcacccugguggagcacaucgagagccccagcagcaucuggguguucgccggcgcccccgacagaugcccccccaccugccuguucgugggcggcauggccgagcugggcgccuucuucagcauccugcaggacaugagaaacaccaucauggccagcaagaccgugggcaccgccgacgagaagcugagaaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaagccuggcccagauccugaucgaccagaaggugaaggagaucagcaaccaggagcccaugaagcuguga

SEQ ID NO: 5232 - RNA, 1287 nt, Artificial Sequence
  derived and/or modified CDS sequence (opt4) from SNV(H10)__NC_005216.1__N
augagcacccugaaggaggugcaggacaacaucacccugcacgagcagcagcuggugaccgccagacagaagcugaaggacgccgagagagccguggagcuggaccccgacgacgugaacaagagcacccugcagagcagaagagccgccgugagcgcccuggagaccaagcugggcgagcugaagagagagcuggccgaccugaucgccgcccagaagcuggccagcaagcccguggaccccaccggcaucgagcccgacgaccaccugaaggagaagagcagccugagauacggcaacgugcuggacgugaacagcaucgaccuggaggagcccagcggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgacuuccuggccgccagaugccccuuccugcccgagcagaaggaccccagagacgccgcccuggccaccaacagagccuacuucaucaccagacagcugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccagcgaggagaagcugaagaagaagagcgccuucuaccagagcuaccugagaagaacccagagcaugggcauccagcuggaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5233 - RNA, 1287 nt, Artificial Sequence
  derived and/or modified CDS sequence (opt4) from SNV(2)__JQ690282.1__N
augagcacccugaaggaggugcaggacaacaucacccugcacgagcagcagcuggugaccgccagacagaagcugaaggacgccgagagagccguggagcuggaccccgacgacgugaacaagagcacccugcagagcagaagagccgccgugagcgcccuggagaccaagcugggcgagcugaagagagagcuggccgaccugaucgccgcccagaagcuggccagcaagcccguggaccccaccggcaucgagcccgacgaccaccugaaggagaagagcagccugagauacggcaacgugcuggacgugaacagcaucgaccuggaggagcccagcggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgacuuccuggccgccagaugccccuuccugcccgagcagaaggaccccagagacgccgcccuggccaccaacagagccuacuucaucaccagacagaugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccagcgaggagaagcugaagaagaagagcgccuucuaccagagcuaccugagaagaacccagagcaugggcauccagcuggaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5234 - RNA, 1287 nt, Artificial Sequence
  derived and/or modified CDS sequence (opt4) from SNV(3)__JQ690278.1__N
augagcacccugaaggaggugcaggacaacaucacccugcacgagcagcagcuggugaccgccagacagaagcugaaggacgccgagagagccguggagcuggaccccgacgacgugaacaagagcacccugcagagcagaagagccgccgugagcgcccuggagaccaagcugggcgagcugaagagagagcuggccgaccugaucgccgcccagaagcuggccagcaagcccguggaccccaccggcaucgagcccgacgaccaccugaaggagaagagcagccugagauacggcaacgugcuggacgugaacagcaucgaccuggaggagcccagcggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgacuuccuggccgccagaugccccuuccugcccgagcagaaggaccccagagacgccgcccuggccaccaacagagccuacuucaucaccagacagcugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccagcgaggagaagcugaagaagaagagcgccuucuaccagagcuaccugagaagaacccagagcaugggcauccagcccgaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5235 - RNA, 1287 nt, Artificial Sequence
  derived and/or modified CDS sequence (opt4) from SNV(CC107/POR)__KT885046.1__N
augagcacccugaaggaggugcaggacaacaucacccugcacgagcagcagcuggugaccaccagacagaagcugaaggacgccgagagagccguggagcuggaccccgacgacgugaacaagagcacccugcagagcagaagagccgccgugagcgcccuggagaccaagcugggcgagcugaagagagagcuggccgaccugaucgccgcccagaagcuggccagcaagcccguggaccccaccggcaucgagcccgacgaccaccugaaggagaagagcagccugagauacggcaacgugcuggacgugaacagcaucgaccuggaggagcccagcggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgaguuccuggccgccagaugccccuuccugcccgagcagaaggaccccagagacgccgcccuggccaccaacagagccuacuucaucaccagacagaugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccagcgaggagaagcugaagaagaagagcgccuucuaccagagcuaccugagaagaacccagagcaugggcauccagcuggaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5236 - RNA, 1287 nt, Artificial Sequence
  derived and/or modified CDS sequence (opt4) from HPS(Convict Creek 107)__L33683.1__N
augagcacccugaaggaggugcaggacaacaucacccugcacgagcagcagcuggugaccaccagacagaagcugaaggacgccgagagagccguggagcuggaccccgacgacgugaacaagagcacccugcagagcagaagagccgccgugagcgcccuggagaccaagcugggcgagcugaagagagagcuggccgaccugaucgccgcccagaagcuggccagcaagcccguggaccccaccggcaucgagcccgacgaccaccugaaggagaagagcagccugagauacggcaacgugcuggacgugaacagcaucgaccuggaggagcccagcggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgaguuccuggccgccagaugccccuuccugcccgagcagaaggaccccagagacgccgcccuggccaccaacagagccuacuucaucaccagacagaugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucggcauccugcaggacaugagaaacaccaucauggccagcaagagcgugggcaccagcgaggagaagcugaagaagaagagcgccuucuaccagagcuaccugagaagaacccagagcaugggcauccagcuggaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5237 - RNA, 1287 nt, Artificial Sequence
  derived and/or modified CDS sequence (opt4) from HPS(Convict Creek 74)__L33816.1__N
augagcacccugaaggaggugcaggacaacaucacccugcacgagcagcagcuggugaccagcagacagaagcugaaggacgccgagagagccguggagcuggaccccgacgacgugaacaagagcacccugcagagcagaagagccgccgugagcgcccuggagaccaagcugggcgagcugaagagagagcuggccgaccacaucgccgcccagaagcuggccagcaagcccguggaccccaccggcaucgagcccgacgaccaccugaaggagaagagcagccugagauacggcaacgugcuggacgugaacagcaucgaccuggaggagcccaacggccagaccgccgacuggaagagcaucggccuguacauccugagcuucgcccugcccaucauccugaaggcccuguacaugcugagcaccagaggcagacagaccaucaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucagcuucuucgugaaggacuggauggagagaaucgacgaguuccuggccgccagaugccccuuccugcccgagcagaaggaccccagagacgccgcccuggccaccaacagagccuacuucaucaccagacagcugcagguggacgagagcaaggugagcgacaucgaggaccugaucgccgacgccagagccgagagcgccaccaucuucgccgacaucgccaccccccacagcguguggguguucgccugcgcccccgacagaugcccccccaccgcccuguacguggccggcaugcccgagcugggcgccuucuucggcauccugcaggacaugagaaacaccaucauggccagcaagagcgugggcaccagcgaggagaagcugaagaagaagagcgccuucuaccagagcuaccugagaagaacccagagcaugggcauccagcuggaccagaagaucaucauccuguacaugagccacuggggcagagaggccgugaaccacuuccaccugggcgacgacauggaccccgagcugagagagcuggcccagacccugguggacaucaaggugagagagaucagcaaccaggagccccugaagcuguga

SEQ ID NO: 5238 - RNA, 1287 nt, Artificial Sequence
  derived and/or modified CDS sequence (opt4) from HPS(H-NY1)__U47135.1__N
augagcacccugaaggaggugcaggacaacaucacccugcacgagcagcagcuggugaccgccagacagaagcugaaggacgccgagaaggccguggagguggaccccgacgacgugaacaagagcacccugcagggcagaagagccgccgugagcgcccuggagaccaagcugggcgagcugaagagacagcuggccgaccugaucgccgcccagaagcuggccagcaagcccaucgaccccaccggcaucgagcccgacgaccaccugaaggagaagagcagccugagauacggcaacgugcuggacgugaacagcaucgaccuggaggagcccagcggccagaccgccgacuggaaggccaucggcauguacauccugagcuucgccauccccaucauccugaaggcccuguacaugcugagcaccagaggcagacagaccgugaaggagaacaagggcaccagaaucagauucaaggacgacagcagcuacgaggaggugaacggcaucagaaagcccagacaccuguacgugagcaugcccaccgcccagagcaccaugaaggccgacgagaucacccccggcagauucagaaccaucgccugcggccuguuccccgcccaggugaaggccagaaacaucaucagccccgugaugggcgugaucggcuucaacuucuucgugaaggacuggauggacagaaucgacgacuuccuggccgagagaugccccuuccugcccgagcccagagaccccaaggacgccgcccugggcaccaacagagccuacuucaucaccagacaggcccagguggacgagagcaaggugguggacaucgaggagcugaucguggacgccagagccgagagcgccacccuguucaccgacaucgccaccccccacagcguguggguguucgccugcgcccccgacagaugcccccccaccgcccuguacguggccggcaugcccgagcugggcgccuucuucgccauccugcaggacaugagaaacaccaucauggccagcaagagcgugggcaccgccgaggagaagcugaagaagaagagcgccuucuaccagagcuaccugagaagaacccagagcaugggcauccagcuggaccagaagaucaucauccuguacaugauccacuggggcaaggaggccgugaaccacuuccaccugggcgacgacauggaccccgagcugagagagcuggcccaggcccugguggacgccaaggugaaggagaucagcaaccaggagccccugaagcuguga

SEQ ID NO: 5239 - RNA, 1290 nt, Artificial Sequence
  derived and/or modified CDS sequence (opt4) from THAIV(Nakhon Ratchasima/Bi0017/2004)__AM397664.1__N
auggccaccauggaggagcugcagagagagaucaacgcccacgagggccagcuggugguggccagacagaaggugaaggacgccgagaagcaguacgagaaggaccccgacgaccugaacagaagagcccugcacgacagagagagcguggccgccagcauccagagcaagaucgacgagcugaagagacagcuggccgacagaaucgccagcggcagaaccaucggccaggacagagaccccaccggcguggagcccggcgaccaccugagagagagaagcaugcugagcuacggcaacgugcuggaccugaacaaccuggacaucgaggagcccaccggccagaccgccgacuggcugaccaucaucguguaccugaccagcuucgugauccccaucauccugaaggcccuguacaugcugaccaccagaggcagacagaccaccaaggacaacaagggcaugagaaucagauucaaggacgacagcagcuacgaggacgugaacggcaucagaaagcccaagcaccuguacaucagcaugcccaacgcccagagcagcaugaaggccgaggagaucacccccggcagauucagaaccgccgugugcggccuguaccccgcccaggugaaggccagaaacauggugagccccgugaugagcgugaucggcuucauggcccuggccaaggacuggaccgacagaauccaggacuggcugggcgcccccugcaaguuccugcccgaccugagcacccagagccugcacgccagcccccccaccaacgccgacuacaucgcccagagacagggccugcuggccggcauggagaccaaggagagcaagggcaucagagaccacgccagagacgccggcugcacccugguggaccaccuggacagccccagcagcaucuggguguucgccggcgcccccgacagaugcccccccaccugccuguucaucgccggcauggccgagcugggcgccuucuucagcauccugcaggacaugagaaacaccaucauggccagcaagaccgugggcaccagcgaggagaagcugaagaagaagagcagcuucuaccagagcuaccugagaagaacccagagcaugggcauccagcuggaccagagaaucaucgugauguucaugguggccuggggcaaggaggccguggacaacuuccaccugggcgacgacauggaccccgagcugagaaaccuggcccagcugcugaucgaccagaaggugaaggagaucagcaaccaggagccccugaagcuguga

SEQ ID NO: 5240 - RNA, 1290 nt, Artificial Sequence
  derived and/or modified CDS sequence (opt4) from TULV(Tula/Moravia/5302Ma/94)__NC_005227.2__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaccggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagagcggccccagcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcagacccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5241 - RNA, 1293 nt, Artificial Sequence
  derived and/or modified CDS sequence (opt4) from TULV(D17-98)__AF289820.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggaguuccuggugagcuacgacgccuaccugcugggcagagagaaggcccugagagagagccaccuggccgagaucgacgaccugaucgaccuggccgccagcggcgaccccaccccccccgacagcaucaagagcccccagggccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5242 - RNA, 1293 nt, Artificial Sequence
  derived and/or modified CDS sequence (opt4) from TULV(D5-98)__AF289819.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggaguuccuggugagcuacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5243 - RNA, 1293 nt, Artificial Sequence
  derived and/or modified CDS sequence (opt4) from TULV(D63-98)__AF289821.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaaggaggaguuccugaucaagcccugccccuuccugaagaagcagggcggccccaacaaggacgaggaguuccuggugagcaacgacgccuaccugcugggcagagagaaggcccugagagagagccaccuggccgagaucgacgaccugaucgaccuggccgccagcggcgaccccaccccccccgacagcaucaagagcccccagggccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5244 - RNA, 1290 nt, Artificial Sequence
  derived and/or modified CDS sequence (opt4) from TULV(MG23/Omsk)__AF442621.1__N
augagcacccugaaggagauccaggaggagaucaccagacacgagcagcagaucgugaucgccagacagaagcugaaggacgccgagaagaccguggaggccgaccccgacgacgugaacaagaacacccugcagagcagaagagccgccgugagcacccuggaggacaagcuggccgaguucaagagacagcuggccgaccuggugagcagccagaagaugggcgagaagcccguggaccccaccggccuggagcccgacgaccaccugaaggagagaagcagccugagauacggcaacgugcuggacgugaacgccaccgacaucgacgagcccagcggccagaccgccgacugguucagcaucggccaguacaucaugggcuucgcccuggccaucgugcugaaggcccuguacaugcugagcaccagaggcagacagaccaucaaggagaacaagggcaccagaaucaaguucaaggacgacagcagcaucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcagcaccaaggaggaggaguuccuggugagcaacgacgccuacaugcugggcagagagaaggcccugagagagagccaccuggccgagaucgacgagcugaucgaccuggccgacagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5245 - RNA, 1290 nt, Artificial Sequence
  derived and/or modified CDS sequence (opt4) from TULV(c109-s)__AF164094.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaccggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagagcggccccagcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccagcgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5246 - RNA, 1290 nt, Artificial Sequence
  derived and/or modified CDS sequence (opt4) from TULV(CHEVRU/Hu/FRA/2015/15.00453)__KT946591.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagacaggccgccgugagcgcccuggaggacaagcuggccgacuucaagagaaagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacgugaugggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagagcggccccagcaaggaggaggacuuccuggugagcaacgacgccuaccugcugggcagagagaaggcccugagagacagccaccuggccgagaucgacgaccugaucgaccuggccgagagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaucgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5247 - RNA, 1290 nt, Artificial Sequence
  derived and/or modified CDS sequence (opt4) from TULV(g20-s)__AF164093.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagacaggccgccgugagcgcccuggaggacaagcuggccgacuucaagagaaagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacgugaugggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagagcggccccagcaaggaggaggacuuccuggugagcaacgacgccuaccugcugggcagagagaaggcccugagagacagccaccuggccgagaucgacgaccugaucgaccuggccgagagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5248 - RNA, 1293 nt, Artificial Sequence
  derived and/or modified CDS sequence (opt4) from TULV(Sennickerode Sen05/174)__EU439948.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggacuuccuggugagcaacgacgccuacuuccugggcagagagaaggcccugagagagagccaccugaacgagaucgacgaccugaucgagcuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5249 - RNA, 1293 nt, Artificial Sequence
  derived and/or modified CDS sequence (opt4) from TULV(Sennickerode Sen05/175)__EU439949.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggacuuccuggugagcaacgacgccuacuuccugggcagagagaaggcccugagagagagccaccugaacgagaucgacgaccugaucgagcuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaagagcaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5250 - RNA, 1293 nt, Artificial Sequence
  derived and/or modified CDS sequence (opt4) from TULV(TUL/Karatal/Ma322/2003)__AM945877.1__N
augagccagcugaaggagauccaggaggagaucaccagacacgagcagcagaucgugaucgccagacagaagcugaaggacgccgagaagaccguggaggccgaccccgacgacgugaacaagaacacccugcagagcagaagagccgccgugagcgcccuggaggacaagcuggccgaguucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacgugaugggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagcagggcagcagcggcaaggaggaggaguuccuggugagcaacgacgccuaccugaucggcagagagaagacccugcaggagagccaccugaccgagaucgacgaccugaucgaccuggccgacagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5251 - RNA, 1293 nt, Artificial Sequence
  derived and/or modified CDS sequence (opt4) from TULV(Tula/Kosice144/Ma/95)__Y13979.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagcagggcgcccccggcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5252 - RNA, 1293 nt, Artificial Sequence
  derived and/or modified CDS sequence (opt4) from TULV(Tula/Kosice667/Ma/95)__Y13980.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagcagggcgcccccggcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacaucgccggcauggccgagcugggcgccuucuucagcauccugcaggacaugagagacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5253 - RNA, 1290 nt, Artificial Sequence
  derived and/or modified CDS sequence (opt4) from TULV(Tula/Koziky/5247Ma/94)__AJ223600.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaccggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagaacggccccagcaaggaggaggacuuccuggugagcaacgacgccuaccugcugggcagagagaaggcccugagagagagccaccuggccgagaucgacgaccugaucgaccuggccgccagcgaggaccccaccccccccgacagcaucaagagcccccaggcccccuggguguucgccugcagacccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacaugagccccgagcugagaacccuggcccagagccugaucgaccagaaggugaaggagaucagcaaccaggagccccugaagaucuga

SEQ ID NO: 5254 - RNA, 1290 nt, Artificial Sequence
  derived and/or modified CDS sequence (opt4) from TULV(Tula/Moravia/5302v/95)__Z69991.1__N
augagccagcugaaggagauccaggaggagaucaccagacacgagcagcagaucgugaucgccagacagaagcugaaggacguggagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaccggcuucgcccuggccaucauccugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucauguacagaaacaucaucagccccgugaugggcgugaucggcuucagcuucuucgugaaggacuggcccgagaagaucgaggaguuccugaucaagcccugccccuuccugaagaagagcggccccagcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcagacccgacagaugcccccccaccugcaucuacaucgccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5255 - RNA, 1293 nt, Artificial Sequence
  derived and/or modified CDS sequence (opt4) from TULV__AF017659.1__N
augagccagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaucggcuucgcccuggccaucgugcugaaggcccuguacaugcugagcaccagaggcagacagaccaucaaggagaacaagggcaccagaaucagauucaaggacgacagcagcuucgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgagaagaucgaggaguuccugaucaagcccugccccuuccugaagaagcagggcgcccccggcaaggaggaggacuuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugaccgaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5256 - RNA, 1293 nt, Artificial Sequence
  derived and/or modified CDS sequence (opt4) from TULV(Lodz-1)__AF063892.1__N
augaccgagcugaaggagauccaggaggagaucaccagacacgagcagcagaucgugaucgccagacagaagcugaaggacgccgagaagaccguggaggccgaccccgacgacgugaacaagagcacccugcagagcagaagagccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaugggcuucgcccuggccaucgugcugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggaguuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5257 - RNA, 1293 nt, Artificial Sequence
  derived and/or modified CDS sequence (opt4) from TULV(Lodz-2)__AF063897.1__N
augaccgagcugaaggagauccaggaggagaucaccagacacgagcagcagaucgugaucgccagacagaagcugaaggacgccgagaagaccguggaggccgaccccgacgacgugaacaagagcacccugcagagcagaugggccgccgugagcgcccuggaggacaagcuggccgacuucaagagacagcuggccgaccuggugagcagccagaagaugggcgagaagcccguggaccccaccggccuggagcccgacgaccaccugaaggagagaagcagccugagauacggcaacgugcuggacgugaacgccaucgacaucgacgagcccagcggccagaccgccgacugguucagcaucggccaguacaucaugggcuucgcccuggccaucgugcugaaggcccuguacaugcugagcaccagaggcagacagaccaucaaggagaacaagggcaccagaaucagauucaaggacgacagcagcuacgaggagaucaacggcaucagaagacccaagcaccuguacgugagcaugcccaccgcccagagcaccaugaaggccgacgagcugacccccggcagauucagaaccaucgugugcggccuguuccccgcccagaucaugcacagaaacaucaucagccccgugaugggcgugaucggcuucagcuucuucgugaaggacuggcccgacaagaucgaggaguuccugaucaagcccugccccuuccugaagaagcagggcggccccaacaaggacgaggaguuccuggugagcaacgacgccuaccugcugggcagagagaaggcccugagagagagccaccuggccgagaucgacgaccugaucgaccuggccgccagcggcgaccccaccccccccgacagcaucaagagcccccaggcccccuggguguucgccugcgcccccgacagaugcccccccaccugcaucuacguggccggcauggccgagcugggcgccuucuucagcauccugcaggacaugagaaacaccaucauggccagcaagaccgugggcaccgccgaggagaagcugaagaagaagagcagcuucuaccagagcuaccugagaagaacccagagcaugggcauccagcuggaccagagaaucauccugcuguucaugauggaguggggcagcgacaucgugaaccacuuccaccugggcgacgacauggaccccgagcugagaacccuggcccagagccugaucgaccagaaggugaaggagaucagcaaccaggagccccugaagaucuga

SEQ ID NO: 5258 - RNA, 1449 nt, Artificial Sequence
  derived and/or modified CDS sequence (opt4) from CCHFV(IbAr10200)__NC_005302.1/U88410.1__N
auggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcugaccggcuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagccacgagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagagcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgaggugcagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5259 - RNA, 1449 nt, Artificial Sequence
  derived and/or modified CDS sequence (opt4) from CCHFV(Turkey-Kelkit06)__GQ337053.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaaggacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcccaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcgagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccaggagaccggcuucaacauccaggacauggacaucguggccagcgagcaccugcugcaccagagcaucgugggcaagcagagccccuuccagaacgccuacaacgugaagggcaacgccaccagcgccaacaucaucuga

SEQ ID NO: 5260 - RNA, 1449 nt, Artificial Sequence
  derived and/or modified CDS sequence (opt4) from CCHFV(Baghdad 12)__AJ538196.1__N
auggagaacaagaucgaggugaacagcaaggacgagaugaacaagugguucgaggaguucaagaagggcaacggccugguggacaccuacaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacaccggcaccaucaagagcugggacgagagcuacaccgagcugaagguggaggugcccaagaucgagcagcuguucaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacauggugaccaaccugcugaagcacguggccaaggcccaggagcuguacaagaacagcagcgcccugagagcccagggcgcccagaucgacaccguguucagcagcuacuacuggcuguacaaggccggcgugacccccgagaccuuccccaccgugagccaguuccuguucgagcugggcaagcaccccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccagaaccaucgugaagcuguucgagauccagaagaccggcuucaacauccagcacauggacaucguggccagcgagcaccugcugcaccagagccuggugggcaagcagagccccuuccagaacgccuacaacgugaagggcaacgccaccagcgccaacaucaucuga

SEQ ID NO: 5261 - RNA, 1449 nt, Artificial Sequence
  derived and/or modified CDS sequence (opt4) from CCHFV(SR3)__AJ538198.1__N
auggagaacaagaucgaggugaacagcaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccgccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5262 - RNA, 1449 nt, Artificial Sequence
  derived and/or modified CDS sequence (opt4) from CCHFV(Gaib)__KX013446.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5263 - RNA, 1449 nt, Artificial Sequence
  derived and/or modified CDS sequence (opt4) from CCHFV(Hodzha)__KX013449.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucugcgugaacgccaacaccgccgcccugagccagaaggugcugagcgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaccaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccaccggcagaaucagcgagaugggcgugugcuucggcaccgugcccguggccgaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5264 - RNA, 1449 nt, Artificial Sequence
  derived and/or modified CDS sequence (opt4) from CCHFV(IbAn7620)__KX013452.1__N
auggagaacaagaucgaggugaacaacaaggacgagaugaacagaugguucgaggaguucaagaaggagaacggccugguggacaccuucaccaacagccacagcuucugcgagagcgugcccaaccuggacaaguucguguuccagauggccagcgccaccgacgacgcccagaaggacagcaucuacgccgccgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccacccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgaggccgagggcaagggcguguucgacgaggccaagaagaccguggaggcccugaacggcuaccuggacaagcacaaggacgagguggacaagagcagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccagcaccgaggccaacaaccccugcgccaagaccaucgugaagcuguucgagauccagaagaagggcuucgugaucaaggacauggacaucguggccagcgagcaccugcugcaccagagccuggugggcaagcagagccccuuccagaacgccuacaacgugaagggcaacgccaccagcgccaacaucaucuga

SEQ ID NO: 5265 - RNA, 1449 nt, Artificial Sequence
  derived and/or modified CDS sequence (opt4) from CCHFV(K128_76)__KX013455.1__N
auggagaacaagaucgaggugaacaacaaggacgagaugaacaagugguucgaggaguucaagaagggcaacggccugguggacaccuucaccaacagcuacagcuucugcgagagcgugcccagccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5266 - RNA, 1449 nt, Artificial Sequence
  derived and/or modified CDS sequence (opt4) from CCHFV(K168_125)__KX013461.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgacaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugaccagcgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5267 - RNA, 1449 nt, Artificial Sequence
  derived and/or modified CDS sequence (opt4) from CCHFV(K168_40)__KX013458.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgacaucgugaugagcgugaaggagaugcugagcgacaugaucagaagaagaaaccugauccugaacagaggcggcgacgagaaccccagaggccccgugagcagagagcacguggaguggugcagagaguucgugaagggcaacuacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugaccagcgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5268 - RNA, 1449 nt, Artificial Sequence
  derived and/or modified CDS sequence (opt4) from CCHFV(K323_27)__KX013473.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuucaacgugaagggcaacgccaccagcgccaacaucaucuga

SEQ ID NO: 5269 - RNA, 1449 nt, Artificial Sequence
  derived and/or modified CDS sequence (opt4) from CCHFV(Min)__KX013482.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagcugggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5270 - RNA, 1449 nt, Artificial Sequence
  derived and/or modified CDS sequence (opt4) from CCHFV(Saf)__KX013488.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccgaccccgacgacgccgcccagggcagcggccacaccaagagcauccugaaccugagaaccagcaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5271 - RNA, 1449 nt, Artificial Sequence
  derived and/or modified CDS sequence (opt4) from CCHFV(UCCR4459)__KY484031.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccggcuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagcugggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5272 - RNA, 1449 nt, Artificial Sequence
  derived and/or modified CDS sequence (opt4) from CCHFV(YL16070)__KY354080.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagagacuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5273 - RNA, 1449 nt, Artificial Sequence
  derived and/or modified CDS sequence (opt4) from CCHFV(66019)__AJ010648.1__N
auggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccagcuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaccaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccgaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5274 - RNA, 1449 nt, Artificial Sequence
  derived and/or modified CDS sequence (opt4) from CCHFV(8402)__AJ010649.1__N
auggagaacaagaucgaggugaacaacaaggacgagaugaacaagugguucgaggaguucaagaagggcaacggccugguggacaccuucaccaacagcuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccuguucaagcacaucgccaaggcccaggagcuguacaagaaccugagcgcccugggcgcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5275 - RNA, 1449 nt, Artificial Sequence
  derived and/or modified CDS sequence (opt4) from CCHFV(Bul/HU517)__AY277676.2__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcgccaucaagagcugggacgagaacuacguggagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcagcgacgagaaccccagaggccccgugagccacgagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5276 - RNA, 1449 nt, Artificial Sequence
  derived and/or modified CDS sequence (opt4) from CCHFV(V46/13)__KR011837.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcagcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaaggccguggaggcccugaacggcuaccuggacaagcacagagacgagguggugaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5277 - RNA, 1449 nt, Artificial Sequence
  derived and/or modified CDS sequence (opt4) from CCHFV(1231-CR/TI-2015)__KU161587.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5278 - RNA, 1449 nt, Artificial Sequence
  derived and/or modified CDS sequence (opt4) from CCHFV(AP92)__U04958.1__N
auggagaacaagaucgaggugaacagcaaggacgaccugaacaagugguucgaggaguucaagaagggcaacggccugguggacaccuucaccaacagcuacagcuucugcgagaacgugcccaaccuggacagauucguguaccagauggccagcgccaccgacgacgcccagaaggacagcaucuacgccagcgcccugguggaggccaccaaguacugcgcccccaucuacgagugcgccugggugagcagcaccggcaucgugaagaagggccuggagugguucgagaagaacaccagcaccaucaagagcugggacgagagcuacaccgagcugaagguggacauccccaagaucgagcagcugagcagcuaccagcaggccgcccugaaguggagaaaggacaucggcuucagaaucaacgccaacaccaccgcccugagcaacaaggugcuggccgaguacaaggugcccggcgagauccuggugcccgugaaggagaugcugagcgacaugaucagaagaagaaacaucauccugaacagaggcagcgacgagaaccccagaggccccgugagccacgagcacaucgaguggugcagagaguucaucaagggcaaguacaucauggccuucaacccccccuggggcgacaucaacaagagcggcagaagcggcaucgcccugguggccaccggccuggccaagcuggccgagaccgagggcaagggcguguucgaggaggccaagaagaccguggaggcccugaaggacuaccuggacaagcacagagacgagguggacaagaccagcgccgacaacauggugaccagccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcacuacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagagcaacaaccccugcgccagaaccaucgugaagcuguucgagauccagaagaccggcuucgacaucaaggacauggacaucguggccagcgagcaccugcugcaccagagccuggugggcaagcagagccccuuccagaacgccuacaacgugaagggcaacgccaccagcgccaacaucaucuga

SEQ ID NO: 5279 - RNA, 1449 nt, Artificial Sequence
  derived and/or modified CDS sequence (opt4) from CCHFV(C68031)__M86625.1__N
auggagaacaagaucgaggugaacaacaaggacgagaugaacaagugguucgaggaguucaagaagggcaacggccugguggacaccuucaccaaccccuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaucgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5280 - RNA, 1449 nt, Artificial Sequence
  derived and/or modified CDS sequence (opt4) from CCHFV(1-CR/HU-2015)__KU161586.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguaccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaccaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5281 - RNA, 1449 nt, Artificial Sequence
  derived and/or modified CDS sequence (opt4) from CCHFV(36-ST-2014)__KR814838.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacaccggcaccaucaagagcugggacgacaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacggcaaccccagaggccccgugagccacgagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagagaaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5282 - RNA, 1449 nt, Artificial Sequence
  derived and/or modified CDS sequence (opt4) from CCHFV(37-ST-2009)__KR814835.1__N
auggagaacaagaucguggugaacagcaaggacgagaugaacaagugguucgaggaguucaagaaggugaacggccugguggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcuggccagcuaccagcaggccgcccugaaguggagaaaggacaucggcuucagagugaacgccaacaccgccgcccugagcagcaaggugcugagcgaguacaaggugcccggcgagguggugaugcccgugaaggagaugcugagcgacaugaucagaagaagaaaccugauccugaacagaggcagcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgaggaggccagaaagaccguggacgcccugaaggacuaccuggacagacacaaggaggagguggacaagaccaacgccgacaacauggugaccaaccuguucaagcacaucgccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccagaaagaugaagaaggcccugcugagcacccccaugaaguggggcaagaagcuguacgagcuguucgccgacgacagcuuccagcagaacagaaucuacaugcaccccgccgugcugaccgccggcagagugagcgagaugggcgugugcuucggcaccauccccguggacaaccccgacgacgccgcccagggcagcggccacaccaagagcauccugaaccugagaaccagcgccgagaccaacaaccccugcgccagaaccaucgugaagcuguucgagauccagaaggccggcuucaacauccaggagauggacaucguggccagcgagcaccugcugcaccagagccuggugggcaagcagagccccuuccagaacgccuacaacgugaagggcaacgccaccagcgccaacaucaucuga

SEQ ID NO: 5283 - RNA, 1449 nt, Artificial Sequence
  derived and/or modified CDS sequence (opt4) from CCHFV(59-TK-2012)__KR814833.1__N
auggagaacaagaucguggugaacagcaaggacgagaugaacaagugguucgaggaguucaagaaggugaacggccugguggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacaccggcaccaucaagagcugggacgagagcuacaccgagcugaagguggacgugcccaagaucgagcagcuggccagcuaccagcaggccgcccugaaguggagaaaggacaucggcuucagagugaacgccaacaccgccgcccugagcagcaaggugcugagcgaguacaaggugcccggcgagaucgugaugcccgugaaggagaugcugagcgacaugaucagaagaagaaaccugauccugaacagaggcagcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgaggaggccagaaagaccguggacgcccugaaggacuaccuggacagacacaaggaggagguggacaagaccaacgccgacaacauggugaccaaccuguucaagcacaucgccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccagaaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggacaaccccgacgacgccgcccagggcagcggccacaccaagagcauccugaaccugagaaccagcgccgagaccaacaaccccugcgccaagaccaucgugaagcuguucgagauccagaaggccggcuucaacauccaggagauggacaucguggccagcgagcaccugcugcaccagagccuggugggcaagcagagccccuuccagaacgccuacaacgugaagggcaacgccaccagcgccaacaucaucuga

SEQ ID NO: 5284 - RNA, 1449 nt, Artificial Sequence
  derived and/or modified CDS sequence (opt4) from CCHFV(73-ST-2013)__KR814836.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5285 - RNA, 1449 nt, Artificial Sequence
  derived and/or modified CDS sequence (opt4) from CCHFV(75-ST-2010)__KR814845.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcagcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5286 - RNA, 1449 nt, Artificial Sequence
  derived and/or modified CDS sequence (opt4) from CCHFV(CHH)__KU707898.1__N
auggagaacaagaucgaggugaacagcaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5287 - RNA, 1449 nt, Artificial Sequence
  derived and/or modified CDS sequence (opt4) from CCHFV(CJH)__KU707899.1__N
auggagaacaagaucgaggugaagaacaagcacgagaagaacaagugguucgaggaguucaagaagggcaacggccugguggacaccuucaccaacagcuacagcuucugcgagaacgugcccaaccuggacagauucguguuccagauggccggcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagaggcaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5288 - RNA, 1449 nt, Artificial Sequence
  derived and/or modified CDS sequence (opt4) from CCHFV(CLT/TI05146)__DQ227496.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5289 - RNA, 1449 nt, Artificial Sequence
  derived and/or modified CDS sequence (opt4) from CCHFV(CYT/TI05099)__DQ227495.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccccaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5290 - RNA, 1449 nt, Artificial Sequence
  derived and/or modified CDS sequence (opt4) from CCHFV(Dubai 616)__JN108025.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5291 - RNA, 1449 nt, Artificial Sequence
  derived and/or modified CDS sequence (opt4) from CCHFV(GRH)__KU707900.1__N
auggagaacaagaucgaggugaacagcaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcauguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5292 - RNA, 1449 nt, Artificial Sequence
  derived and/or modified CDS sequence (opt4) from CCHFV(Iran-Gilan69)__KJ027521.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccagcuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5293 - RNA, 1449 nt, Artificial Sequence
  derived and/or modified CDS sequence (opt4) from CCHFV(Iran-Isfahan78)__KJ027522.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5294 - RNA, 1449 nt, Artificial Sequence
  derived and/or modified CDS sequence (opt4) from CCHFV(Iran-KhRazavi72)__KJ485700.1__N
auggagaacaagaucgaggugaagaacaagcacgagaagaacaagugguucgaggaguucaagaagggcaacggccugguggacaccuuccccaacagcuacagcuucugcgagaacgugcccaaccuggacagauucguguuccagauggccggcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagaggcaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucaucaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5295 - RNA, 1449 nt, Artificial Sequence
  derived and/or modified CDS sequence (opt4) from CCHFV(Iran-Zahedan19)__KJ676542.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugaucgccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugagauggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5296 - RNA, 1449 nt, Artificial Sequence
  derived and/or modified CDS sequence (opt4) from CCHFV(NIV 112143)__JN572089.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugaucgccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugagauggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5297 - RNA, 1449 nt, Artificial Sequence
  derived and/or modified CDS sequence (opt4) from CCHFV(NIVA 118595)__JN572088.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugagauggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5298 - RNA, 1449 nt, Artificial Sequence
  derived and/or modified CDS sequence (opt4) from CCHFV(SPU 130/89)__KJ682821.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucguguga

SEQ ID NO: 5299 - RNA, 1449 nt, Artificial Sequence
  derived and/or modified CDS sequence (opt4) from CCHFV(SPU 18/88)__KJ682818.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcauggugaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5300 - RNA, 1449 nt, Artificial Sequence
  derived and/or modified CDS sequence (opt4) from CCHFV(SPU 187/90)__KJ682823.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugcagaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5301 - RNA, 1449 nt, Artificial Sequence
  derived and/or modified CDS sequence (opt4) from CCHFV(SPU 383/87)__KJ682816.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccggcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccagcaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucguguga

SEQ ID NO: 5302 - RNA, 1449 nt, Artificial Sequence
  derived and/or modified CDS sequence (opt4) from CCHFV(SPU 383/87)__KJ682816.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccggcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccagcaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5303 - RNA, 1449 nt, Artificial Sequence
  derived and/or modified CDS sequence (opt4) from CCHFV(SPU 431/85)__KJ682815.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccguguacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacaccuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgugaacaucaucuga

SEQ ID NO: 5304 - RNA, 1449 nt, Artificial Sequence
  derived and/or modified CDS sequence (opt4) from CCHFV(SPU 45/88)__KJ682819.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5305 - RNA, 1449 nt, Artificial Sequence
  derived and/or modified CDS sequence (opt4) from CCHFV(SPU 48/90)__KJ682822.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccuguucaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucagcauccaggacauggacaucguggccagcgagcaccugcugcaccagagccuggugggcaagcagagccccuuccagaacgccuacaacgugaagggcaacgccaccagcgccaacaucaucuga

SEQ ID NO: 5306 - RNA, 1449 nt, Artificial Sequence
  derived and/or modified CDS sequence (opt4) from CCHFV(SPU 497/88)__KJ682820.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcgccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5307 - RNA, 1449 nt, Artificial Sequence
  derived and/or modified CDS sequence (opt4) from CCHFV(SPU 556/87)__KJ682817.1__N
auggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5308 - RNA, 1449 nt, Artificial Sequence
  derived and/or modified CDS sequence (opt4) from CCHFV(SPU 92/01)__KC880335.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugcagaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgugaacaucaucuga

SEQ ID NO: 5309 - RNA, 1449 nt, Artificial Sequence
  derived and/or modified CDS sequence (opt4) from CCHFV(SRR)__KU707901.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugagauggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5310 - RNA, 1449 nt, Artificial Sequence
  derived and/or modified CDS sequence (opt4) from CCHFV(STV/HU29223)__AF481802.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccugagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5311 - RNA, 1449 nt, Artificial Sequence
  derived and/or modified CDS sequence (opt4) from CCHFV(TAJ/HU8966)__AY049083.2__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccgaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5312 - RNA, 1449 nt, Artificial Sequence
  derived and/or modified CDS sequence (opt4) from CCHFV(TAJ/HU8975)__AY297692.2__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaucgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5313 - RNA, 1449 nt, Artificial Sequence
  derived and/or modified CDS sequence (opt4) from CCHFV(TAJ/HU8978)__AY297691.2__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccggcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccuguuccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagagaaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccagcuucagcagcuacuacuggcuguacaaggccggcagaacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5314 - RNA, 1449 nt, Artificial Sequence
  derived and/or modified CDS sequence (opt4) from CCHFV(Uzbek/TI10145)__AF481799.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5315 - RNA, 1449 nt, Artificial Sequence
  derived and/or modified CDS sequence (opt4) from CCHFV(ROS/TI28044)__AY277672.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagcccggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucgccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5316 - RNA, 1449 nt, Artificial Sequence
  derived and/or modified CDS sequence (opt4) from CCHFV(7001)__AF415236.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagagccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugccccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5317 - RNA, 1449 nt, Artificial Sequence
  derived and/or modified CDS sequence (opt4) from CCHFV(79121M18)__GU477494.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggaggugcccaagaucgagcagcuggccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagagccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5318 - RNA, 1449 nt, Artificial Sequence
  derived and/or modified CDS sequence (opt4) from CCHFV(AP92)__DQ211638.1__N
auggagaacaagaucgaggugaacagcaaggacgaccugaacaagugguucgaggaguucaagaagggcaacggccugguggacaccuucaccaacagcuacagcuucugcgagaacgugcccaaccuggacagauucguguaccagauggccagcgccaccgacgacgcccagaaggacagcaucuacgccagcgcccugguggaggccaccaaguacugcgcccccaucuacgagugcgccugggugagcagcaccggcaucgugaagaagggccuggagugguucgagaagaacaccagcaccaucaagagcugggacgagagcuacaccgagcugaagguggacauccccaagaucgagcagcugagcagcuaccagcaggccgcccugaaguggagaaaggacaucggcuucagaaucaacgccaacaccaccgcccugagcaacaaggugcuggccgaguacaaggugcccggcgagauccuggugcccgugaaggagaugcugagcgacaugaucagaagaagaaacaucauccugaacagaggcagcgacgagaaccccagaggccccgugagccacgagcacaucgaguggugcagagaguucaucaagggcaaguacaucauggccuucaacccccccuggggcgacaucaacaagagcggcagaagcggcaucgcccugguggccaccggccuggccaagcuggccgagaccgagggcaagggcguguucgaggaggccaagaagaccguggaggcccugaaggacuaccuggacaagcacagagacgagguggacaagaccagcgccgacaacauggugaccagccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagagcaacaaccccugcgccagaaccaucgugaagcuguucgagauccagaagaccggcuucgacaucaaggacauggacaucguggccagcgagcaccugcugcaccagagccuggugggcaagcagagccccuuccagaacgccuacaacgugaagggcaacgccaccagcgccaacaucaucuga

SEQ ID NO: 5319 - RNA, 1449 nt, Artificial Sequence
  derived and/or modified CDS sequence (opt4) from CCHFV(ArD15786)__DQ211640.1__N
auggagaacaagaucgaggugaacaacaaggacgagcugaacaagugguucgaggaguucaagaagggcaacggccugguggacaccuucaccaacagcuacagcuucugcgagaacgugcccaaccuggacagauucguguuccagauggccggcgccaccgacgacgcccagaaggacagcaucuacgccagcgcccugguggaggccaccaaguacugcgcccccaucuacgagugcgccugggugagcagcaccggcaucgugaagagaggccuggagugguucgagaagaacaccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcugagcgaguacaaggugcccggcgagaucgugaugagcgugaaggagaugcugagcgacaugaucagaagaagaaaccugauccugaacagaggcggcgacgagaaccccagaggccccgugagcaaggagcacaucgaguggugcagagaguucgugaagggcaaguacaucauggccuucaacccccccuggggcgacgugaacaagagcggcagaagcggcaucgcccugguggccaccggccuggccaagcuggccgagaccgagggcaagggcguguucgaggaggccaagaagaccguggaggcccugaaggaguaccuggacaagcacaaggacgagguggacaaggccagcgccgacagcauggugaccaaccugcugaagcacaucaccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacagcgagaccaacaaccccugcgccaagaccaucgugaagcuguucgaggugcagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5320 - RNA, 1449 nt, Artificial Sequence
  derived and/or modified CDS sequence (opt4) from CCHFV(ArD39554)__DQ211641.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugaccacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5321 - RNA, 1449 nt, Artificial Sequence
  derived and/or modified CDS sequence (opt4) from CCHFV(BT958)__EF123122.1__N
auggagaacaagaucgaggugaacaacaaggacgagaugaacagaugguucgaggaguucaagaaggagaacggccugguggacaccuucaccaacagccacagcuucugcgagagcgugcccaaccuggacaaguucguguuccagauggccagcgccaccgacgacgcccagaaggacagcaucuacgccgccgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccacccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgaggccgagggcaagggcguguucgacgaggccaagaagaccguggaggcccugaacggcuaccuggacaagcacaaggacgagguggacaagagcagcgccgacagcaugaucaccaaccugcugaagcacaucgccaaggcccaggagcuguacagaaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccagcaccgaggccaacaaccccugcgccaagaccaucgugaagcuguucgagauccagaagaagggcuucgugaucaaggacauggacaucguggccagcgagcaccugcugcaccagagccuggugggcaagcagagccccuuccagaacgccuacaacgugaagggcaacgccaccagcgccaacaucaucuga

SEQ ID NO: 5322 - RNA, 1449 nt, Artificial Sequence
  derived and/or modified CDS sequence (opt4) from CCHFV(C-68031)__DQ211642.1__N
auggagaacaagaucgaggugaacaacaaggacgagaugaacaagugguucgaggaguucaagaagggcaacggccugguggacaccuucaccaacagcuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaucgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5323 - RNA, 1449 nt, Artificial Sequence
  derived and/or modified CDS sequence (opt4) from CCHFV(China)__AF354296.1__N
auggagaacaagaucgaggugaacaacaaggacgagaugaacaagugguucgaggaguucaagaagggcaacggccugguggacaccuucaccaacagcuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagcggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccggcggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgccacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugagacuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5324 - RNA, 1449 nt, Artificial Sequence
  derived and/or modified CDS sequence (opt4) from CCHFV(China)__AF358784.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggaggugcccaagaucgagcaguucgccgacuaccagcaggccgcccugaaguggagaaaggacaucggcuucagagugaacgccaacaccaccgcccugagccacaaggugcuggccgaguacaaggugcccggcgagaucgugaugagcgugaaggagaugcugagcgacaugaucagaagaagaaaccugauccugaacagaggcggcgacgagagccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccugaacaagcacaaggacgagguggacaaggccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcaccccccugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5325 - RNA, 1449 nt, Artificial Sequence
  derived and/or modified CDS sequence (opt4) from CCHFV(China)__AF362080.1__N
auggagaacaagaucgaggugaacaacaaggacgagaugaacaagugguucgaggaguucaagaagggcaacggccugguggacaccuucaccaacagcuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcugaccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaccuacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5326 - RNA, 1449 nt, Artificial Sequence
  derived and/or modified CDS sequence (opt4) from CCHFV(China)__AY029157.1__N
auggagaacaagaucgaggugaacaacaaggacgagaugaacaagugguucgaggaguucaagaagggcaacggccugguggacaccuucaccaacagcuacagcuucugcgagagcgugcccaaccuggagagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5327 - RNA, 1449 nt, Artificial Sequence
  derived and/or modified CDS sequence (opt4) from CCHFV(DAK 8194)__U88411.1__N
auggagaacaagaucgaggugaacaacaaggacgagcugaacaagugguucgaggaguucaagaagggcaacggccugguggacaccuucaccaacagcuacagcuucugcgagaacaugcccaaccuggacagauucguguuccagauggccggcgccaccgacgacgcccagaaggacagcaucuacgccagcgcccugguggaggccaccaaguacugcgcccccaucuacgagugcgccugggugagcagcaccggcaucgugaagagaggccuggagugguucgagaagaacaccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcugagcgaguacaaggugcccggcgagaucgugaugagcgugaaggagaugcugagcgacaugaucagaagaagaaaccugauccugaacagaggcggcgacgagaaccccagaggccccgugagcaaggagcacaucgaguggugcagagaguucgugaagggcaaguacaucauggccuucaacccccccuggggcgacgugaacaagagcggcagaagcggcaucgcccugguggccaccggccuggccaagcuggccgagaccgagggcaagggcguguucgaggaggccaagaagaccguggaggcccugaaggaguaccuggacaagcacaaggacgagguggacaaggccagcgccgacagcauggugaccaaccugcugaagcacaucaccaaggcccaggagcuguacaagaacagcagcgcccugagagcccagggcgcccagaucgacacccccuucagcagcuucuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccgaccccgacgacgccgcccagggcagcggccacaccaagagcauccugaaccugagaaccagcagcgagaccaacaaccccugcgccaagaccaucgugaagcuguucgaggugcagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5328 - RNA, 1449 nt, Artificial Sequence
  derived and/or modified CDS sequence (opt4) from CCHFV(Drosdov)__U88412.1__N
auggagaacaagaucgaggugaacagcaaggacgagaugaacaagugguucgaggaguucaagaaggagaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5329 - RNA, 1449 nt, Artificial Sequence
  derived and/or modified CDS sequence (opt4) from CCHFV(Eskisehir23-2012)__KR092376.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacaccggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcggcgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagagaaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5330 - RNA, 1449 nt, Artificial Sequence
  derived and/or modified CDS sequence (opt4) from CCHFV(Hodzha)__AY223475.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcugagcgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaccaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccgugcccguggccgaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5331 - RNA, 1449 nt, Artificial Sequence
  derived and/or modified CDS sequence (opt4) from CCHFV(Iran-52)__DQ446212.1__N
auggagaacaagaucgaggugaacagcaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5332 - RNA, 1449 nt, Artificial Sequence
  derived and/or modified CDS sequence (opt4) from CCHFV(Iran-53)__DQ446213.1__N
auggagaacaagaucgaggugaacagcaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacaagggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5333 - RNA, 1449 nt, Artificial Sequence
  derived and/or modified CDS sequence (opt4) from CCHFV(JD 206)__U88414.1__N
auggagaacaagaucgaggugaacagcaaggacgagaugaacaagugguucgaggaguucaagaagggcaacggccugguggacaccuucaccaacagcuacagcuucugcgagaacgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcauguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5334 - RNA, 1449 nt, Artificial Sequence
  derived and/or modified CDS sequence (opt4) from CCHFV(Kashmanov)__DQ211644.1__N
auggagaacaagaucgaggugaacagcaaggacgagaugaacaagugguucgaggaguucaagaaggagaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5335 - RNA, 1449 nt, Artificial Sequence
  derived and/or modified CDS sequence (opt4) from CCHFV(NIV 10405051)__JF922681.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugagauggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacaucgacaucguggccagcgagcaccugcugcaccagagccuggugggcaagcagagccccuuccagaacgccuacaacgugaagggcaacgccaccagcgccaacaucaucuga

SEQ ID NO: 5336 - RNA, 1449 nt, Artificial Sequence
  derived and/or modified CDS sequence (opt4) from CCHFV(Oman)__DQ211645.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucaucaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5337 - RNA, 1449 nt, Artificial Sequence
  derived and/or modified CDS sequence (opt4) from CCHFV(SCT ex Afghanistan)__JX908640.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagagcugggacgagagcuacaccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucaucaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5338 - RNA, 1449 nt, Artificial Sequence
  derived and/or modified CDS sequence (opt4) from CCHFV(Semunya)__DQ076413.1__N
auggagaacaagaucgaggugaccagcaaggacgagaugaacagaugguucgaggaguucaagaagagcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaaggugggcgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacggcauggugaccaaccugcugaagcacaucgccaaggcccaggagcuguacaagaacagcagcgcccugagagcccagggcgcccagaucgacacccccuucagcagcuucuacuggcuguacaaggccggcgugagccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccaggagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5339 - RNA, 1449 nt, Artificial Sequence
  derived and/or modified CDS sequence (opt4) from CCHFV(SK 2015/human)__KX129738.1__N
auggagaacaagaucgaggugaacaacaaggacgagaugaacaagugguucgaggaguucaagaagggcaacggccugguggacaccuacaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggccagcagcaccggcaucgugaagaagggccuggagugguucgagaagaacgccggcaccaucaagcugugggacgagagcuacgccgagcugaagguggaggugcccaagaucgagcagcugagcaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacagcaugaucaccaaccugcugaagcacaucgccaaggcccaggagcuguacaagaacagcagcgcccugagagcccagggcgcccagaucgacaccguguucagcagcuacuacuggcuguacaaggccggcgugacccccgacaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccgugcccguggccaaccccgacgacgccgcccugggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5340 - RNA, 1449 nt, Artificial Sequence
  derived and/or modified CDS sequence (opt4) from CCHFV(SPU128/81/7)__DQ076415.1__N
auggagaacaagaucgaggugaacaacaagcacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggugcugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5341 - RNA, 1449 nt, Artificial Sequence
  derived and/or modified CDS sequence (opt4) from CCHFV(Sudan Al-Fulah 4-2008)__GQ862372.1__N
auggagaacaagaucgaggugaacaacaaggacgagaugaacaagugguucgaggaguucaagaagggcaacggccugguggacaccuucaccaacagcuacagcuucugcgagagcgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagagaggccuggagugguucgagaagaacgccggcaccaucaagagcugggacgagagcuacaccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccagauccugaacagaggcggcgacgagaaccccagaggccccgugagcagagagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccagaaccaucgugaagcuguucgagauccagaagaccggcuucagcauccaggacauggacaucguggccagcgagcaccugcugcaccagagccuggugggcaagcagagccccuuccagaacgccuacaacgugaagggcaacgccaccagcgccaacaucaucuga

SEQ ID NO: 5342 - RNA, 1449 nt, Artificial Sequence
  derived and/or modified CDS sequence (opt4) from CCHFV(TAJUK)__JN086996.1__N
auggagaacaagaucgaggugaacaacaaggacgagaugaacaagugguucgaggaguucaagaagggcaacggccugguggacaccuucaccaacagcuacagcuucugcgagagcgugcccaaccuggacagauucguguuccagauggccagcgccaccgacgaggcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggaggugcccaagaucgagcagcuggccaacuaccagcaggccgcccugaaguggagaaaggacaucggcuucagagugaacgccaacaccgccgcccugagccacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacaaggacgagguggacaaggccagcgccgacaacaugaucaccaaccugcugaagcacaucgccaaggcccaggagcuguacaagaacagcagcgcccugagagcccagggcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5343 - RNA, 1449 nt, Artificial Sequence
  derived and/or modified CDS sequence (opt4) from CCHFV(UG3010)__DQ211650.1__N
auggagaacaagaucgaggugaccagcaaggacgagaugaacagaugguucgaggaguucaagaagagcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaaggugggcgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggaccugaacggcuaccuggacaagcacaaggacgagguggacaaggccagcgccgacggcauggugaccaaccugcugaagcacaucgccaaggcccaggagcuguacaagaacagcagcgcccugagagcccagggcgcccagaucgacacccccuucagcagcuucuacuggcuguacaaggccggcgugagccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccaggagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5344 - RNA, 1449 nt, Artificial Sequence
  derived and/or modified CDS sequence (opt4) from CCHFV(UGANDA 3010)__U88416.1__N
auggagaacaagaucgaggugaccagcaaggacgagaugaacagaugguucgaggaguucaagaagagcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaaggugggcgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggaccugaacggcuaccuggacaagcacaaggacgagguggacaaggccagcgccgacggcauggugaccaaccugcugaagcacaucgccaaggcccaggagcuguacaagaacagcagcgcccugcugcugcagggcgcccagaucgacacccccuucagcagcuucuacuggcuguacaaggccggcgugagccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccaggagaacagaaucuacaugcaccccgccgugcugaccgccggcagaaucagcgagaugggcgugugcuucggcaccauccccguggccaaccccgacgacgccgcccagggcagcggccacaccaagagcauccugaaccugggcaccaacaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5345 - RNA, 1449 nt, Artificial Sequence
  derived and/or modified CDS sequence (opt4) from CCHFV(UK ex Bulgaria)__KM201260.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccagauucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5346 - RNA, 1449 nt, Artificial Sequence
  derived and/or modified CDS sequence (opt4) from CCHFV(Yozgat19-2012)__KR092375.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaagcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccagaagaccggcuucaacauccaggacauggacaucguggccagcgagcaccugcugcaccagagccuggugggcaagcagagccccuuccagaacgccuaccacgugaagggcaacgccaccagcgccaacaucaucuga

SEQ ID NO: 5347 - RNA, 1449 nt, Artificial Sequence
  derived and/or modified CDS sequence (opt4) from CCHFV(Yozgat207-2011)__KR092377.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcugaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccaggagaccggcuucaacauccaggacauggacaucguggccagcgagcaccugcugcaccagagccuggugggcaagcagagccccuuccagaacgccuacaacgugaagggcaacgccaccagcgccaacaucaucuga

SEQ ID NO: 5348 - RNA, 1452 nt, Artificial Sequence
  derived and/or modified CDS sequence (opt4) from DUGV(ArD44313)__AF434161.1__N
auggagaaccagaucaaggccaacaacaagaaggaguucgacgagugguucaagcccuucagcgagaagcugcagcugagaagcaaccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugaagaagggcauccccgagcccgagcagcuggugagcuaccagcaggccgcccagaaguggagaaaggacgugggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcuggugcagaccaugaccaagcaccuggcccaggccguggagcugagcaagaagagcaacgcccugagagcccagggcgcccagaucgacacccccuucagcgccuacuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuuccugggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5349 - RNA, 1452 nt, Artificial Sequence
  derived and/or modified CDS sequence (opt4) from DUGV(ArD16095)__AF434162.1__N
auggagaaccagaucaaggccaacaacaagaaggaguucgacgagugguucaagcccuucagcgagaagcugcagcugagaagcaaccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacagcaaguacauggaccugagaaagggcauccccgagcccgagcagcuggugagcuaccagcaggccgcccagaaguggagaaaggacgugggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcuggugcagaccaugaccaagcaccuggcccaggccguggagcugagcaagaagagcaacgcccugagagcccagggcgcccagaucgacacccccuucagcgccuacuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuucagcggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5350 - RNA, 1452 nt, Artificial Sequence
  derived and/or modified CDS sequence (opt4) from DUGV(IbH11480)__AF434163.1__N
auggagaaccagaucaaggccaacaacaagaaggaguucgacgagugguucaagcccuucagcgagaagcugcagcugagaagcaaccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugagaaagggcauccccgagcccgagcagcuggugagcuaccagcaggccgcccagaaguggagaaaggacgugggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcuggugcagaccaugaccaagcaccuggcccaggccguggagcugagcaagaagagcaacgcccugagagcccagggcgcccagaucgacacccccuucagcgccuucuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuuccugggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5351 - RNA, 1452 nt, Artificial Sequence
  derived and/or modified CDS sequence (opt4) from DUGV(IbAr1792)__AF434164.1__N
auggagaaccagaucaaggccaacaacaagaaggaguucgacgagugguucaagcccuucagcgagaagcugcagcugagaagcaaccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugagaaagggcauccccgagcccgagcagcuggugagcuaccagcaggccgcccagaaguggagaaaggacgugggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcuggugcagaccaugaccaagcaccuggcccaggccguggagcugagcaagaagagcaacgcccugagagcccagggcgcccagaucgacacccccuucagcgccuacuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuuccugggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5352 - RNA, 1452 nt, Artificial Sequence
  derived and/or modified CDS sequence (opt4) from DUGV(KT281/75)__AF434165.1__N
auggagaaccagaucaaggccaacaccaagaaggaguucgacgagugguucaagcccuucagcgacaagcugcagcugagaagcacccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugagaaagggcauccccgagcccgagcagcuggugagcuaccagcaggccgcccagaaguggagaaaggacaucggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggaucgaggacaacaaggacgcccuggaggacggcaagggcaacgagcugauccagaccaugaccaagcaccuggcccaggccguggagcugagcaagaagagcaacgcccugagagcccagggcgcccagaucgacacccccuucagcgccuucuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuucagcggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5353 - RNA, 1452 nt, Artificial Sequence
  derived and/or modified CDS sequence (opt4) from DUGV(NJT130)__FJ422213.2__N
auggagaaccagaucaaggccaacaacaagaaggaguucgacgagugguucaagcccuucagcgacaagcugcagcugagaagcacccugaccaacagcgccagccugugcgacaaggugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugagaaagggcauccccgagcccgagcagcuggugagcuaccagcaggccgcccagaaguggagaaaggacaucggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccgagggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcugauccagaccaugaccaagcaccuggcccaggccguggagcugagcaagaagagcaacgcccugagagcccagggcgcccagaucgacacccccuucagcgccuucuacugggccuggagcgccggcgugaagcccgagaccuucuucacccugagccaguuccuguucgagaugggccagagcgccagaggcggcaagaagaugaucaaggcccugaccagcaccccccugagauggggcaagggccugaucaaccuguucgccgacgacgacuucagcggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5354 - RNA, 1452 nt, Artificial Sequence
  derived and/or modified CDS sequence (opt4) from DUGV(IbAr1792)__KU925457.1__N
auggagaaccagaucaaggccaacaacaagaaggaguucgacgagugguucaagcccuucagcgagaagcugcagcugagaagcaaccugaccaacagcgccagccugugcgacagagugcccgaccuggcccuggccgagaugaagauggcccuggccaccgacgacaaggagaaggacagcaucuucagcaacgcccugguggaggccaccagauucugcgcccccaucuacgagugcgccuggaccugcagcaccggcguggugcagaagagccugagcugguucgacaagaacaaggacuucaucaagcugugggacgccaaguacauggaccugagaaagggcauccccgagcccgagcagcuggugagcuaccagcaggccgcccagaaguggagaaaggacgugggcuacgagaucaaccaguucaccagaagccugacccaccccgugguggccgaguacaaggugcccggcgagaucgccguggacgugaaggagaugcugagcgacaugaucagaagaagaaacgugcugcugaacggcgacggcgagaacgccggcaagaagggccccaucagcagagagcacgugagcuggggcagagagcuggccggcggcaaguuccaggugguguucaacccccccuggggcgacaucaacaagugcggcaagagcggcaucccccuggccgccaccgccauggugaagguggccgagcuggacggcagcaagaagcuggaggacaucagacaggcccugcuggaccugaagaaguggguggaggacaacaaggacgcccuggaggacggcaagggcaacgagcuggugcagaccaugaccaagcaccuggcccaggccguggagcugagcaagaagagcaacgcccugagagcccagggcgcccagaucgacacccccuucagcgccuucuacugggccuggagcgccggcgugaagcccgagaccuucuucacccugagccaguuccuguucgagaugggccagaacgccagaggcggcaagaagaugaucaaggcccugaccagcaccccccugagauggggcaagggccugaucaaccuguucgccgacgacgacuuccugggcaacagacuguacaugcaccccgccgugcugacccccggcagaaugagcgagaugggcgccugcuucggcgugauccccguggccagccccgaggacgccauccugggcagcggccacagcaagaacauccugaacuucaagaucgacaccagcgugcagaaccccugcgccagcaccaucgugcagcuguacagaauccagaagagcggcuucgaccuggagagccuggagguggugagcaccgagcaccugcugcaccagagcuucgugggcaagagaugccccacccagaacgccuacaaggugagaggcaacgccaccaacgugaacaucaucuga

SEQ ID NO: 5355 - RNA, 1449 nt, Artificial Sequence
  derived and/or modified CDS sequence (opt4) from NSDV(Jilin)__NC_034386.1__N
augcagaaccagaucguggccgacaacaaggacgccauccuggccuggcacaagaccuacagcgagaagcacagacugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugguggagagaggccuggacugguucgagaacaacaaggagaccgugaagaucugggacgccgaguacggcaagcugagaaccgaggcccccagccccgagcagcugcugggcuaccagagagccgcccugaaguggagaaaggacaccaaguacggcaucaacagaaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagaucgccgaggaccugagagagagccugaagggccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccuggcccagaccaccgacacccaggccggcaaccccugcgcccagaacaucguggcccuguucaacauccagaaggccggcuucgacaucgagagcauggacaucguggcccuggagcaccugcugcaccagagccuggugggcaagagaagccccuuccagaacgccuacaacaucagaggcaacgccaccagcauccagaucaucuga

SEQ ID NO: 5356 - RNA, 1449 nt, Artificial Sequence
  derived and/or modified CDS sequence (opt4) from NSDV(62873)__HQ286609.1__N
augcagaaccagaucguggccgacaacaaggacgccauccuggccuggcacaagaccuacagcgagaagcacaagcugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugauccagagaggccuggacugguucgagaacaacggcgagauggugaagaucugggacgccgacuacggcaagcugagaaccgagauccccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagguggccgaggaccugaaggagagccugaagagccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5357 - RNA, 1449 nt, Artificial Sequence
  derived and/or modified CDS sequence (opt4) from NSDV(779)__HQ286602.1__N
augcagaaccagaucguggccgacaacaaggacgccauccuggccuggcacaagaccuacagcgagaagcacaagcugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugauccagagaggccuggacugguucgacaacaacggcgagauggugaagaucugggacgccgacuacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagguggccgaggaccugaaggagagccugaagagccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5358 - RNA, 1449 nt, Artificial Sequence
  derived and/or modified CDS sequence (opt4) from NSDV(6233)__HQ286603.1__N
augcagaaccagaucguggccgacaacaaggacgccauccuggccuggcacaagaccuacagcgagaagcacaagcugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugauccagagaggccuggacugguucgacaacaacggcgagauggugaagaucugggacgccgacuacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagguggccgaggaccugaaggagagccugaagagccugguggccuggaucaacgcccacaaggacgagguggagaacggcaaggacgugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5359 - RNA, 1449 nt, Artificial Sequence
  derived and/or modified CDS sequence (opt4) from NSDV(40350)__HQ286608.1__N
augcagaaccagaucguggccgacagcaaggacgccauccuggccuggcacaagaccuacagcgagaagcacaagcugaagagcgugcugaccaacagcgccagcuucugcgagaccauccccgaccugagcggcuacgaggugagcaugagacuggugagcagcgacagcgagaaggacagcguguacgccagcgcccugguggccgccaccaaguucugcgcccccauccuggagugcgccuggaccagcugcaccggcaugauccagagaggccuggacugguucgagaacaacggcgagauggugaagaucugggacgccgacuacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagaucgccgaggaccugaaggagagccugaagagccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5360 - RNA, 1449 nt, Artificial Sequence
  derived and/or modified CDS sequence (opt4) from NSDV(616287)__HQ286605.1__N
augcagaaccagaucguggccgacaacaaggacgccauccuggccuggcacaagaccuacagcgagaagcacaagcugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugauccagagaggccuggacugguucgacaacaacggcgagauggugaagaucugggacgccgacuacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagaagggccccgugagcaaggagcacguggacugggccagagaccuggcccagggcaaguuccuggugguguucaacccccccuggggcgacaucaacaaggccggcaagagcggcaucgcccuggccgccaccggcauggccaagcugaucgagcuggacggccccaagguggccgaggaccugaaggagagccugaagagccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5361 - RNA, 1449 nt, Artificial Sequence
  derived and/or modified CDS sequence (opt4) from NSDV(615526)__HQ286606.1__N
augcagaaccagaucguggccgacaacaaggacgccauccuggccuggcacaaggccuacagcgagaagcacaagcugaagagcgugcugaccaacagcgccagcuucugcgagaccauccccgaccugagcggcuacgaggugagcaugagacuggugagcagcgagagcgagaaggacagcguguacgccagcgcccugguggccgccaccaaguucugcgcccccauccuggagugcgccuggaccagcugcaccggcaugauccagagaggccuggacugguucgacagcaacggcgagauggugaagaucugggacgccgacuacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacagagugcccggcagcaucguggugaacgugaaggacaugcugagcgacaugaucagaagaagaaacaagauccugaacagagacggcagcgaggacgugcccaagggcggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagaucgccgaggaccugaaggagagccugaagagccugguggccuggaucaacgcccacaaggacgagguggagaacggcaaggaggugguggacggccugaccaagcaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgagggcagcggccacaucaagaacauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5362 - RNA, 1449 nt, Artificial Sequence
  derived and/or modified CDS sequence (opt4) from NSDV(708)__AF504293.1__N
augcagaaccagaucguggccgacaacaaggacgccauccuggccuggcacaaggccuacagcgagaagcacaagcugaagagcgugcugaccaacagcgccagcuucugcgaggccauccccgaccugagcggcuacgaggugagcaugagacuggugagcagcgacagcgagaaggacagcguguacgccagcgcccugguggccgccaccaaguucugcgcccccauccuggagugcgccuggaccagcugcaccggcaugguggagagaggccuggacugguucgagaacaacagagagauggugaagaucugggacaccgaguacggcaagcugagaaccgaggugcccagccccgagcagcugcugggcuaccagagagccgcccugaaguggagaaaggacaccaaguacggcaucaacaagaacaccgccgcccuggccgccgccaucgccaccgaguacaaggugcccggcagccugguggugaacgugaaggacaugcugagcgacaugaucagaagaagaaacaagauccugaacagagacggcagcgaggacgugcccaagagaggccccgugagcaaggagcacaucgacugggccagagaccuggcccagggcaaguuccuggugguguucaacccccccuggggcgacaucaacaaggccggcaagagcggcaucgcccuggccgccaccggcauggccaagcugaucgagcuggacggccccaagaucgccgaggaccugaaggagagccugaagagccugguggccuggaucaacgcccacaaggacgagguggagaacggcaaggaggugguggacagccugaccaaguaccugcagaaggcccuggagcuggccaagcagagcagcgccaugagagcccagggcgcccagaucgacaccguguucagcagcuacuacuggcuguggaaggccggcgugaccgccgagauguuccccaccgugagccaguuccuguucgagcugggcaaggugcccagaggcaacaagaagaugaagaaggcccugagcagcaugccccugaaguggggcaagaagcugcuggcccuguucgccgacgacagcuucaccgccaacagaaucuacaugcaccccggcgugcugaccgccggcagaaugagcgagcugggcgugugcuucggcgccauccccguggccaaccccgacgacgccgccgacggcagcggccacaucaagagcauccugaacuacaagaccgacacccaggccggcaaccccugcgcccagaacaucguggcccuguucaacauccagaaggccggcuucgacaucgagagcauggacaucguggccagcgagcaccugcugcaccagagccuggugggcaagagaagccccuuccagaacgccuacaacaucagaggcaacgccaccagcauccagaucaucuga

SEQ ID NO: 5363 - RNA, 702 nt, Artificial Sequence
  derived and/or modified CDS sequence (opt4) from BUNV__NC_001927.1__N
augaucgagcuggaguuccacgacguggccgccaacaccagcagcaccuucgaccccgagguggccuacgccaacuucaagagagugcacaccaccggccugagcuacgaccacaucagaaucuucuacaucaagggcagagagaucaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5364 - RNA, 702 nt, Artificial Sequence
  derived and/or modified CDS sequence (opt4) from BUNV(SFCrEq231)__KP063894.1__N
augaucgagcuggaguucaacgacguggccgccaacaccagcagcaccuucgaccccgagguggccuacaucaacuucaagagaaucuacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgagcccgagaagcugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccgugagcaaggugaacgaggugcagagcgcccugaccguggugagcggccugggcuggaagaagaccaacgugagcgccgccgccagagaguuccuggccaaguucggcaucaacauguga

SEQ ID NO: 5365 - RNA, 702 nt, Artificial Sequence
  derived and/or modified CDS sequence (opt4) from BUNV(AMH001130)__JF961342.1__N
augaucgagcuggaguuccacgacguggccgccaacaccagcagcaccuucgaccccgagguggccuacgccaacuucaagagagugcacaccaccggccugagcuacgaccacaucagaaucuucuacaucaagggcagagaggugaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5366 - RNA, 702 nt, Artificial Sequence
  derived and/or modified CDS sequence (opt4) from BUNV(ArB29051)__AM709778.1__N
augaucgagcuggaguuccacgacguggccgccaacaccagcagcaccuucgaccccgagguggccuacgccaacuucaagagagugcacaccaccggccugagcuacgaccacaucagaaucuucuacaucaagggcagagagaucaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaagcugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5367 - RNA, 702 nt, Artificial Sequence
  derived and/or modified CDS sequence (opt4) from BUNV(ArB28215)__AM711130.1__N
augaucgagcuggaguucaacgacguggccgugaacaccagcagcagcuucgaccccgaggccgccuacgccaacuucaagagagugcacaccaccggccugagcuacgaccacaucagaaucuucuacaucaagggcagagagaucaaggugagccugagcaagagaagcgagugggaggugaccaucaaccugggcggcuggaagaucgccguguacaacaccaacuuccccggcaacagaaacagccccgugcccgacgacggccugacccugcacagacugagcggcuuccuggccagauuccugcuggagaagaugcugaagaugagcgagcccgagaagcugaucaucaaggccaagaucaucaacccccuggccgagaagaacagaaucaccuggaacgacggcgaggagguguaccugagcuucuuccccggcagcgagauguuccugggcaccuucaaguucuacccccuggccaucggcaucuacaaggugcagagaaaggagauggagcccaaguacuucgagaagaccaugagacagagauacaugggccuggaggccagcagcuggaccgugagcaagcugaccgacgugcagagcgcccugaccguggugagcggccugggcuggaagaagaccaacgugagcgccgccgccagagacuuccuggccaaguucggcaucaacauguga

SEQ ID NO: 5368 - RNA, 702 nt, Artificial Sequence
  derived and/or modified CDS sequence (opt4) from BUNV(Peurto Almendras)__AJ697960.1__N
augagcgagaucgccuucgacgacaucggccagaucgccgccagcaccuucaaccccgacaaccaguacaucggcuucaagaagguguucaccaucggccugaccuacgaccagaucagaaucuucuuccugaacggcaagaaggccaaggagacccugagcaagagaagcgaggagaccgugacccugaacuucggcggcuggagaauccccaucgugaacacccacuuccccggcaacagaaacaucgaccuggccgacgacgcccugacccugcacagagugagcggcuaccuggccagauaccugcuggagaaggugcugagcgcccaggagcccgagaaggugaucaucaagaccagaaucaucaaccccaucgccgccagcaacggcaucaccugggacgacggcuacgagguguaccugagcuucuuccccggcagcgagugcuuccuggaggccuucaaguucuacccccuggccaucggcaucuacaaggugcagaagggcaugauggacgugaaguuccuggagaagaccaugagacagaaguacgccggccuggacgccaccguguggacccagcagaaguacaccgacgugaucaacgcccugcugguggugaacggccugggcuggaagaagagcaacgugagcgccgccgccaaggacuuccugagcaaguucggcauccagaucuga

SEQ ID NO: 5369 - RNA, 702 nt, Artificial Sequence
  derived and/or modified CDS sequence (opt4) from BUNV__AF325122.1__N
augaucgagcuggaguucaacgacguggccgccaacaccagcagcaccuucgaccccgagguggccuacaucaacuucaagagacuguacaccaccggccugagcuacgaccacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuaccuggccagauaccugcuggagaagauccugaaggugagcgaccccgagaagcugaucaucaagagcaagaucaucaacccccuggccgagaagaacggcaucaccuggagcgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5370 - RNA, 702 nt, Artificial Sequence
  derived and/or modified CDS sequence (opt4) from Ab-BUNV(Cu20-XJ)__KJ710424.1__N
augcuggagcuggaguucgaggacgugcccaccaacaucggcagcaccuucgaccccgagagcggcuacaucaacuuccagagaaacuaccugcccggcgugacccuggaccagaucagaaucuucuacaucaagggcagagagaucaagaacagccuggccaagagaagcgagugggaggugacccugaaccugggcggcuggaaggugcccgugcugaacaccaacuuccccggcaacagaagcaacgccgugcccgacuacggccugaccuuccacagaaucagcggcuaccuggccagauaccugcugggcaaguaccuggccgagaccgagcccgagaagcugaucaugagaaccaagaucaucaacccccuggccgagaagaacggcaucaccugggagagcggccccgagguguaccugagcuucuuccccggcgccgagauguuccugggcaccuucaaguucuacccccuggccaucggcaucuacaaggugcagagaaaggagauggaccccaaguuccuggagaagaccaugagacagagauaccugggccuggacgcccagaccuggaccaccaccaagcuggacgagguggagagagcccugaagguggugagcggccugggcuggaagaagaccaacgugagcaacgccgccagagaguuccugagcaaguucggcaucagaauguga

SEQ ID NO: 5371 - RNA, 702 nt, Artificial Sequence
  derived and/or modified CDS sequence (opt4) from ANADV(2513 Irkutsk)__KT313716.1__N
augaucgagcuggaguucaacgacguggccgccaacaccagcagcaccuucgaccccgagguggccuacaucaacuucaagagaaucuacaccaccggccugagcuacgaccacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccagauucggcaucaacauguga

SEQ ID NO: 5372 - RNA, 702 nt, Artificial Sequence
  derived and/or modified CDS sequence (opt4) from ANADV(EIV-23263Tyum)__KT313761.1__N
augaucgagcuggaguucaacgacguggccgccaacaccagcagcaccuucgaccccgagguggccuacaucaacuucaagagaaucuacaccaccggccugagcuacgaccacaucagaaucuucuacaucaagggcagagagaucaagaccagccuggccaagagaagcgagugggaggugacccugaaccugggcggcuggaagaucaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccagauucggcaucaacauguga

SEQ ID NO: 5373 - RNA, 702 nt, Artificial Sequence
  derived and/or modified CDS sequence (opt4) from BATV__X73464.1__N
augaucgagcuggaguucaacgacguggccgccaacaccagcagcaccuucgaccccgagguggccuacaucaacuucaagagaaucuacaccaccggccugagcuacgacaacaucagaaucuucuacaucaagggcagagagaucaagaccagccugagcaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucgugaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5374 - RNA, 702 nt, Artificial Sequence
  derived and/or modified CDS sequence (opt4) from BATV(668)__KT313687.1__N
augaucgagcuggaguucaacgacguggccgccaacaccagcagcaccuucgaccccgagguggccuaccugaacuucaagagaaucuacaccaccggccugagcuacgacaacaucagaaucuucuacaucaagggcagagagaucaaggugagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccuggagcgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucaacauguga

SEQ ID NO: 5375 - RNA, 702 nt, Artificial Sequence
  derived and/or modified CDS sequence (opt4) from BATV(804922)__FJ436805.1__N
augaucgagcuggaguucaacgacguggccgccaacaccagcagcaccuucgaccccgagguggccuacaucaacuucaagagaaucuacaccaccggccugagcuacgacaacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucgugaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5376 - RNA, 702 nt, Artificial Sequence
  derived and/or modified CDS sequence (opt4) from BATV(8627-11)__FJ436802.1__N
augaucgagcuggaguucaacgacguggccgccaacaccagcagcaccuucgaccccgagguggccuacaucaacuucaagagaaucuacaccaccggccugagcuacgacaacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucgugaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacacagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5377 - RNA, 702 nt, Artificial Sequence
  derived and/or modified CDS sequence (opt4) from BATV(G-20217)__FJ436806.1__N
augaucgagcuggaguucaacgacguggccgccaacaccagcagcaccuucgaccccgagguggccuacaucaacuucaagagaaucuacaccaccggccugagcuacgacaacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucgugaacccccuggccgagaagaacggcaucaccugggccgacggcgaggagguguaccugagcuucuuccccggcagcgagauguuccugggcaccuucagauucuacccccugagcaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5378 - RNA, 702 nt, Artificial Sequence
  derived and/or modified CDS sequence (opt4) from BATV(MS50)__JX846604.1__N
augaucgagcuggaguucaacgacguggccgccaacaccagcagcaccuucgaccccgagguggccuacgccaacuucaagagagugcacaccaccggccugagcuacgaccacgugagaaucuucuacaucaagggcagagagaucaagaccagccugagcaagagaagcgagugggaggugacccugaaccugggcggcuggaagaucgccguguacaacaccaacuuccccagcaacagaaacaaccccgugcccgacgacggccugacccugcacagacugagcggcuaccuggccagauaccuguucgagaagaucgugaaggugagcgagcccgagaagcugcugaucaagagcaagaucaucaacccccuggccgagaagaacggcaucaccugggccgacggcgaggagaucuaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccggcaccuggaccgugagcaaggugaacgaggugcaggccgccgugaacguggugagcacccugggcuggaagaagaccaacgugagcgccgccgccagagaguuccuggccaaguucggcaucgccauguga

SEQ ID NO: 5379 - RNA, 702 nt, Artificial Sequence
  derived and/or modified CDS sequence (opt4) from BATV(ON-1/E/94)__AB257761.1__N
augaucgagcuggaguucaacgacguggccgccaacaccagcagcaccuucgaccccgagguggccuacaucaacuucaagagaguguacaccaccggccugagcuacgacaacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucgugaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5380 - RNA, 702 nt, Artificial Sequence
  derived and/or modified CDS sequence (opt4) from BATV(UgMP-6830)__JX846601.1__N
augaucgagcuggaguucaacgacguggccgccaacaccagcagcaccuucgaccccgagguggccuacaucaacuucaagagaaucuacaccaccggccugagcuacgacaacaucagaaucuucuacaucaagggcagagagaucaagaccagccuggccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccgugagcaagcugaacgaggugcagagcgcccugaccguggugagcggccugggcuggaagaagaccaacgugagcagcgccgccagagaguuccuggccaaguucggcaucagcauguga

SEQ ID NO: 5381 - RNA, 702 nt, Artificial Sequence
  derived and/or modified CDS sequence (opt4) from BIRV(ArB2198)__AM711131.1__N
augaucgagcuggaguuccaccacguggccgccaacaccagcagcaccuucgaccccgagguggccuacgccaacuucaagagaauccacaccaacggccugagcuacgacaacaucagaaucuucuacaucaagggcagagagaucaagaccagccuggccaagagaagcgagugggaggugacccugaaccugggcggcuggaagguggccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagaccaagaucaucaacccccuggccgagaagaacggcaucaccuggaaggacggcgaggagguguaccugagcuucuuccccggcagcgagauguuccugggcaccuucaaguucuacccccuggccaucggcaucuacaaggugcagaagaaggagauggaccccaaguaccuggagaagaccaugagacagagauacaugggccuggaggccagcaccuggaccgugagcaaggugagcgaggugcagagcgcccugaccguggugagcagccugggcuggaagaagaccaacgugaccgccgccgccagagacuucuucgccaaguucggcaucaacauguga

SEQ ID NO: 5382 - RNA, 702 nt, Artificial Sequence
  derived and/or modified CDS sequence (opt4) from BOZOV(ArB13529)__AM711132.1__N
augaucgagcuggaguucaacgacguggccgccaacaccagcagcaccuucgaccccgaggccgccuacgccaacuucaagagagugcacaccaccggccugaccuacgaccacaucagaaucuucuacaucaagggcagcgagaucaagaccagccuggccaagagaagcgagugggaggugacccugaaccugggcggcuggaagaucaccguguacaacaccaacuuccccggcaacagaaacaaccccagccccgacgacggccugacccugcacuucuucugcggcuuccuggccaagagccugcuggagaagaugcugaaggugagcgcccccgagaagcugaucaucaagagcaagaucaccagcccccuggccgagaagaacggcaucaccuggaacgacggcgaggagguguaccugagcuucuuccccggcagcgagauguuccugggcaccuuccacuucuacccccugcccaucggcaucuaccagggccugagaagagaccuggagcccaaguacuucggcaagacccugagacugauguacaugggccuggaggccagcagcuggaccgugagcaagcugaccgagggccagagcgcccugaccguggugagcggccugggcuggaagaagaccaacgugagcgccgccgccagagacuuccuggccaaguucggcaucaacauguga

SEQ ID NO: 5383 - RNA, 702 nt, Artificial Sequence
  derived and/or modified CDS sequence (opt4) from CVV__X73465.1__N
augaucgagcuggaguucaacgacguggccgccaacaccagcagcaccuucgaccccgagaucgccuacgugaacuucaagagaauccacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuaccuggccagauaccugcuggagaagauccugaaggugagcgaccccgagaaggugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccaucagcaaggugaacgaggugcaggccgcccugaccguggugagcggccugggcuggaagaagaccaacgugagcgccgccgccagagaguuccuggccaaguucggcaucagcauguga

SEQ ID NO: 5384 - RNA, 702 nt, Artificial Sequence
  derived and/or modified CDS sequence (opt4) from CVV(10081)__KP835932.1__N
augaucgagcuggaguucaacgacguggccgccaacaccagcagcaccuucgaccccgagaucgccuacgugaacuucaagagaaucuacaccaccggccugagcuacgaccacaucagaaucuucuacaucaagggcagagagaucaagaccagccugaccaagagaagcgagugggaggugacccugaaccugggcggcuggaagaucaccguguucaacaccaacuuccccggcaacagaaacagccccgugcccgacgacggccugacccugcacagacugagcggcuaccuggccagauaccugcuggagaagauccugaaggugagcgaccccgagaaggugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccaucagcaaggugaacgaggugcaggccgcccugaccguggugagcggccugggcuggaagaagaccaacgugagcgccgccgccagagaguuccuggccaaguucggcaucagcauguga

SEQ ID NO: 5385 - RNA, 702 nt, Artificial Sequence
  derived and/or modified CDS sequence (opt4) from CHLV(CHLV-Mex07)__EU879062.3__N
augaucgagcuggaguucaacgacguggccgccaacaccagcagcaccuucgaccccgagaucgccuacgugaacuucaagagaaucuacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuaccuggccagauaccugcuggagaagauccugaaggugagcgaccccgagaaggugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccgugagcaaggugaacgaggugcaggccgcccugaccguggugagcggccugggcuggaagaagaccaacgugagcgccgccgccagagaguuccuggccaaguucggcaucagcauguga

SEQ ID NO: 5386 - RNA, 702 nt, Artificial Sequence
  derived and/or modified CDS sequence (opt4) from GERV__M19420.1__N
augcuggagcuggaguucgaggacgugcccaacaacaucggcagcaccuucgaccccgagagcggcuacaccaacuuccagagaaacuaccugcccggcgugacccuggaccagaucagaaucuucuacaucaagggcagagagaucaagaacagccugagcaagagaagcgagugggaggugacccugaaccugggcggcuggaaggugcccgugcugaacaccaacuuccccggcaacagaaacaacgccgugcccgacuacggccugaccuuccacagaaucagcggcuaccuggccagauaccugcugggcaaguaccuggccgagaccgagcccgagaagcugaucaugagaaccaagaucgugaacccccuggccgagaagaacggcaucaccugggagagcggccccgagguguaccugagcuucuuccccggcgccgagauguuccugggcaccuucagauucuacccccuggccaucggcaucuacaaggugcagagaaaggagauggaccccaaguuccuggagaagaccaugagacagagauaccugggcaucgacgcccagaccuggaccaccaccaagcugggcgagguggaggccgcccugaagguggugagcggccugggcuggaagaagaccaacgugagcagcgccgccagagaguuccugagcaaguucggcaucagaauguga

SEQ ID NO: 5387 - RNA, 702 nt, Artificial Sequence
  derived and/or modified CDS sequence (opt4) from IACOV(BeAn314206)__JN572067.1__N
augagcgagaucaucuucgacgacgugggccagaucaccagcagcaccuucaaccccgacgugcaguacaucaacuucaagaagaaccacaccaccggccugaacuacgaccagaucagaguguucuuccugaacggcaagaaggccaaggagacccuggccaagagaagcgaggagagccugcagcugaacuucggcggcuggagagugguggugaugaacacccacuuccccggcaacagaaacaugcugauccccgacgaggccaugacccugcacagacugagcggcuaccuggccagauaccugcuggagagaauccugagcggccccgagcacgagaagguggugaucaccagcaagaucgugaaccccaucgccgccagcaacggcaucaccuggaccgacggccccgagguguaccugagcuucuuccccggcaccgagauguuccuggagagcuucaaguucuacccccuggccaucggcaucuacaaggugcagaagaagaugauggagagcaaguaccuggagaaggccaugagacagaaguacagcggcauggacgccacccuguggacccagcagaaguacgccgaggugaccaacgcccuggccguggugagcaaccugggcuggaagaagagcaacgugagcgccgccgccagagacuuccuggccaaguucggcauccagcuguga

SEQ ID NO: 5388 - RNA, 702 nt, Artificial Sequence
  derived and/or modified CDS sequence (opt4) from ILEV(ArB16282)__AM709780.1__N
augaucgagcuggaguuccacgacgugaccgccaacaccagcagcaccuucgaccccgagguggccuacgccaacuucaagagaauccacaccaacggccugaacuacgaccacaucagaaucuucuacaucaagggcagagagaucaagaccagccuggccaagagaagcgagugggaggugacccugaaccugggcggcuggaagaucagcguguacaacaccaaguuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccugguacgacggcgaggagguguaccugagcuucuuccccggcagcgagaugugccugggcacccaggacuucuaccccauggccaucgaguucuaccaggugcagagaaaggagauggagcccaaguuccuggagaagacccugaagcagagaagccugggccuggagcccagcaccuggaccaucagccagcuggugaagcugcagagcgcccugaccguggugagcggccugggcuggaagaagaccaacgugggcgccgccgccagaaacuuccuggccaaguucggcaucaacauguga

SEQ ID NO: 5389 - RNA, 702 nt, Artificial Sequence
  derived and/or modified CDS sequence (opt4) from ILEV(HB80P125)__AM709779.1__N
augaucgagcuggaguuccacgacgugaccgccaacaccagcagcaccuucgaccccgagguggccuacgccaacuucaagagaauccacaccaacggccugaacuacgaccacaucagaaucuucuacaucaagggcagagagaucaagaccagccuggccaagagaagcgagugggaggugacccugaaccugggcggcuggaagaucgccguguacaacaccaacuuccccggcaacagaaacaaccccgugcccgacgacggccugacccugcacagacugagcggcuaccuggccagaugccugcuggagaagaugcugaaggugagcgagcccgagaagcagaucaucaagagcaagaucaucaacccccuggccgagaagaacggcaucaccugggacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccaucagcaagcuggccgaggugcagagcgcccugaccguggugagcggccugggcuggaagaagaccaacgugagcgccgccgccagagacuuccuggccaaguucggcaucaacauguga

SEQ ID NO: 5390 - RNA, 702 nt, Artificial Sequence
  derived and/or modified CDS sequence (opt4) from ILEV(ILESHA/8e)__KC608151.1__N
augaucgagcuggaguuccacgacgugaccgccaacaccagcagcaccuucgaccccgagguggccuacgccaacuucaagagaauccacaccaacggccugaacuacgaccacaucagaaucuucuacaucaagggcagagagaucaagaccagccuggccaagagaagcgagugggaggugacccugaaccugggcggcuggaagaucgccguguacaacaccaacuuccccggcaacagaaacaaccccauccccgacgacggccugacccugcacagacugagcggcuaccuggccagauaccugcuggagaagaugcugaaggugagcgagcccgagaagcagaucaucaagagcaagaucaucaacccccuggccgagaagaacggcaucaccugggacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccaucagcaagcuggccgaggugcagagcgcccugaccguggugagcggccugggcuggaagaagaccaacgugagcgccgccgccagagacuuccuggccaaguucggcaucaacauguga

SEQ ID NO: 5391 - RNA, 702 nt, Artificial Sequence
  derived and/or modified CDS sequence (opt4) from ILEV(R5964)__AY729651.1__N
augaucgagcuggaguuccacgacgugaccgccaacaccagcagcaccuucgaccccgagguggccuacgccaacuucaagagaauccacaccaacggccugaacuacgaccacaucagaaucuucuacaucaagggcagagagaucaagaccagccuggccaagagaagcgagugggaggugacccugaaccugggcggcuggaagaucgccguguacaacaccaacuuccccggcaacagaaacaaccccauccccgacgacggccugacccugcacagacugagcggcuaccuggccagauaccugcuggagaagaugcugaaggugagcgagcccgagaagcagaucaucaagagcaagaucaucaacccccuggccgagaagaacggcaucaccugggacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccaucagcaagcuggccgaggugcagagcgcccugaccguggugagcggccugggcuggaagaagaccaacgugagcgcccccgccagagacuuccuggccaaguucggcaucaacauguga

SEQ ID NO: 5392 - RNA, 702 nt, Artificial Sequence
  derived and/or modified CDS sequence (opt4) from MAGV__D13783.1__N
augaucgagcuggaguucaacgacguggccgccaacaccagcagcaccuucgaccccgagaucgccuacgugaacuucaagagaauccacaccaccggccugagcuacgaccacaucagagugcuguacaucaagggcagagagaucaagaccagccugaccaagagaagcgagugggaggugacccugaaccugggcggcuggaagguggccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucaaguucuacccccuggccaucggcaucuacaaggugcagaagaaggagauggagcccaaguaccuggagaagaccaugagacagagauacaugggccuggaggccgccaccuggaccgugagcaaggugaacgaggugcaggccgcccugaccguggugagcggccugggcuggaagaagaccaacgugagcgccgccgccagagaguuccuggccaaguucggcaucaacauguga

SEQ ID NO: 5393 - RNA, 702 nt, Artificial Sequence
  derived and/or modified CDS sequence (opt4) from MAGV(7272)__KX100103.1__N
augaucgagcuggaguucaacgacguggccgccaacaccagcagcaccuucgaccccgagaucgccuacgugaacuucaagagaauccacaccaccggccugagcuacgaccacaucagagugcuguacaucaagggcagagagaucaagaccagccugaccaagagaagcgagugggaggugacccugaaccugggcggcuggaagguggccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccgccaccuggaccgugagcaaggugaacgaggugcaggccgcccugaccguggugagcggccugggcuggaagaagaccaacgugagcgccgccgccagagaguuccuggccaaguucggcaucaacauguga

SEQ ID NO: 5394 - RNA, 702 nt, Artificial Sequence
  derived and/or modified CDS sequence (opt4) from MAGV(3363)__KX100106.1__N
augaucgagcuggaguucaacgacguggccgccaacaccagcagcaccuucgaccccgagaucgccuacgugaacuucaagagaaucuacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuaccuggccagauaccugcuggagaagauccugaaggugagcgaccccgagaaggugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccaucagcaaggugaacgaggugcaggccgcccugaccguggugagcggccugggcuggaagaagaccaacgugagcgccgccgccagagaguuccuggccaaguucggcaucagcauguga

SEQ ID NO: 5395 - RNA, 702 nt, Artificial Sequence
  derived and/or modified CDS sequence (opt4) from NRIV(DakArY357/6e)__AY593727.1__N
augaucgagcuggaguuccacgacgugaccgccaacaccagcagcaccuucgaccccgagguggccuacgccaacuucaagagaauccacaccaacggccugaacuacgacuacaucagaaucuucuacaucaagggcagagagaucaagaccagccuggccaagagaagcgagugggaggugacccugaaccugggcggcuggaagaucgccguguacaacaccaacuuccccggcaacagaaacaaccccauccccgacgacggccugacccugcacagacugagcggcuaccuggccagauaccugcuggagaagaugcugaaggugagcgagcccgagaagcagaucaucaagagcaagaucaucaacccccuggccgagaagaacggcaucaccugggacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccagcaccuggaccaucagcaagcuggccgaggugcagagcgcccugaccguggugagcggccugggcuggaagaagaccaacgugagcgccgccgccagagacuuccuggccaaguucggcaucaacauguga

SEQ ID NO: 5396 - RNA, 702 nt, Artificial Sequence
  derived and/or modified CDS sequence (opt4) from NORV__X73470.1__N
augaucgagcuggaguucaacgacguggccgccaacaccagcagcaccuucgaccccgagguggccuacaucaacuucaagagaguguacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgagcccgagaagcugaucaucaagagcaagaucaucaacccccuggccgagaagaacggcaucaccuggaccgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccaucagcaaggugaacgaggugcaggccgcccugaccguggugagcggccugggcuggaagaagaccaacgugagcgccgccgccagagaguuccuggccaaguucggcaucaacauguga

SEQ ID NO: 5397 - RNA, 702 nt, Artificial Sequence
  derived and/or modified CDS sequence (opt4) from POTV(89-3380)__AY729652.1__N
augaucgagcuggaguucaacgacguggccgccgacaccagcagcaccuucgaccccgagaucgccuacgugaacuucaagagaauccacaccaccggccugagcuacgaccacaucagaaucuucuacaucaagggcagagagaucaagaccagccugaccaagagaagcgagugggaggugacccugaaccugggcggcuggaagaucaccguguucaacaccaacuuccccggcaacagaaacagccccgugcccgacgacggccugacccugcacagacugagcggcuaccuggccagauaccugcuggagaagauccugaaggugagcgaccccgagaaggugaucaucaagagcaagaucaucaacccccuggccgagaagaacggcaucaccuggagcgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccagcaccuggaccgugagcaaggugaacgaggugcaggccgcccugaccguggugagcggccugggcuggaagaagaccaacgugagcgccgccgccagagaguuccuggccaaguucggcaucagcauguga

SEQ ID NO: 5398 - RNA, 702 nt, Artificial Sequence
  derived and/or modified CDS sequence (opt4) from SHOV(4042)__EU564831.1__N
augaucgagcuggaguuccacgacguggccgccaacaccagcagcaccuucgaccccgagguggccuacgccaacuucaagagagugcacaccaccggccugagcuacgaccacaucagaaucuucuacaucaagggcagagagaucaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaccgacggcgaggagguguaccugagcuucuuccccggcgccgagauguuccugggcaccuucaaguucuacccccuggccaucggcaucuacaaggugcagagaaaggagauggagcccaaguaccuggagaagaccaugagacagagauacaugggccuggaggccgccaccuggaccgugagcaagcugaccgaggugcaggccgcccugaccguggugagcggccugggcuggaagaagaccaacgugagcgccgccgccagagacuuccuggccaaguucggcaucagcauguga

SEQ ID NO: 5399 - RNA, 702 nt, Artificial Sequence
  derived and/or modified CDS sequence (opt4) from TENV(TSV-FE3-66FB)__FJ943505.1__N
augaucgagcuggaguucaacgacguggccgccaacaccagcagcaccuucgaccccgaggugggcuacgugaacuucaagagagugcacaccaccggccugagcuacgaccacaucagaaucuucuacaucaagggcagagagaucaagaccagccugaccaagagaagcgagugggaggugacccugaaccugggcggcuggaaggugaccguguucaacaccaacuuccccggcaacagaaacagccccgugcccgacgacggccugacccugcacagacugagcggcuuccuggccagauaccugcuggagaagauccugaaggugagcgaccccgagaagcugaucaucaagagcaagaucaucaacccccuggccgagaagaacggcaucaccugggccgacggcgaggagguguaccugagcuucuuccccggcagcgagauguuccugggcaccuucaaguucuacccccuggccaucggcaucuacaaggugcagagaaaggagauggagcccaaguaccuggagaagaccaugagacagagauacaugggccuggaggccgccaccuggaccaucagcaaggugaacgaggugcagagcgcccugaccguggugagcggccugggcuggaagaagaccaacgugagcgccgccgccagagaguuccuggccaaguucggcaucaacauguga

SEQ ID NO: 5400 - RNA, 702 nt, Artificial Sequence
  derived and/or modified CDS sequence (opt4) from XINV(BeH388464)__EU564830.1__N
augcuggagcuggaguucaacgacguggccgccaacaccagcagcaccuucgaccccgaggugggcuacgccaacuucaagagaauccacaccaacggccugagcuacgacaacaucagaaucuucuacaucaagggcagagagaucaagaccagccuggccaagagaagcgagugggaggugacccugaaccugggcggcuggaagaucaccguguacaacaccaacuuccccggcaacagaaaccaccccauccccgacgacggccugaccauccacagacugagcggcuaccuggccagauaccugcuggagaagauccugaaggugagcgaccccgagaagcugcugaucaagaccaagaucaucaacccccuggccgagaagaacggcaucaccuggaacgacggcgaggagguguaccugagcuucuuccccggcagcgagauguuccugggcaccuucaaguucuacccccuggccaucggcaucuacaaggugcagagaaaggagauggagcccaaguaccuggagaaggccaugagacagagauacaugggccuggagagcgccaccuggaccgugagcaagcugaacgaggugcagagcgcccugaccguggugagcggccugggcuggaagaagaccaacgugagcgccgccgccagagaguuccuggccaaguucggcaucaacauguga

SEQ ID NO: 5401 - RNA, 702 nt, Artificial Sequence; identical to SEQ ID NO: 5363
  derived and/or modified CDS sequence (opt4) from NRIV(9800535)__JX857328.1__N

SEQ ID NO: 5402 - RNA, 702 nt, Artificial Sequence
  derived and/or modified CDS sequence (opt4) from NRIV(Adrar)__KJ716848.1__N
augaucgagcuggaguuccacgacguggccgccaacaccagcagcaccuucgaccccgagguggccuacgccaacuucaagagaaucuacaccaccggccugagcuacgaccacaucagaaucuucuacaucaagggcagagagaucaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5403 - RNA, 702 nt, Artificial Sequence
  derived and/or modified CDS sequence (opt4) from NRIV(D28542/4e)__KC608154.1__N
augaucgagcuggaguuccacgacguggccgccaacaccagcagcaccuucgaccccgagguggccuacgccaacuucaagagaguguacaccaccggccugagcuacgaccacaucagaaucuucuacaucaagggcagagagaucaagaccagccuggccaagagaagcgagugggaggugacccugaaccugggcggcuggaagaucaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5404 - RNA, 702 nt, Artificial Sequence
  derived and/or modified CDS sequence (opt4) from NRIV(SUD-HKV141)__JX857322.1__N
augaucgagcuggaguuccacgacguggccgccaacaccagcagcaccuucgaccccgagguggccuacgccaacuucaagagagugcacaccaccggccugagcuacgaccacaucagaaucuucuacaucaagggcagagagaucaagaccagccuggccaagagaagcgagugggaggugacccugaaccugggcggcuggaaggugaccguguacaacaccaacuuccccggcaacagaaacaaccccgugcccgacgacggccugacccugcacagacugagcggcuuccuggccagauaccugcuggagaagaugcugaaggugagcgagcccgagaagcugaucaucaagagcaagaucaucaacccccuggccgagaagaacggcaucaccuggaacgacggcgaggagguguaccugagcuucuuccccggcagcgagauguuccugggcaccuucagauucuacccccuggccaucggcaucuacaaggugcagagaaaggagauggagcccaaguaccuggagaagaccaugagacagagauacaugggccuggaggccgccaccuggaccgugagcaagcugaccgaggugcagagcgcccugaccguggugagcagccugggcuggaagaagaccaacgugagcgccgccgccagagacuuccuggccaaguucggcaucaacauguga

SEQ ID NO: 5405 - RNA, 705 nt, Artificial Sequence
  derived and/or modified CDS sequence (opt4) from BWAV(M459)__NC_034480.1__N
augagcgaccugaucuucuacgacguggacagcgugaacgccaacgaguucgaccccgacaccggcuaccuggacuucaagaacaacuaccccggcgcccugaacaccaacaccgccagaaccuucuuccugaacgccgccaaggccaagaacgugcugagaaacaagcccgacaagaaggugaaccccaaguucggcaacugggagguggagguggugaacaaccacuuccccggcaacagaaacaaccccaucggcaaggacgaccugacccugcacagaaucagcggcuaccuggccagauggauccuggaggaguacaagagagacgacgagagcgagaaggagaucaucgagagcaccgugaucaaccccaucgccgagagcaacggcaucagauggagcgacggcgccgagaucuaccugagcuucuuccccggcaccgagauguuccuggagcccuucaaguucuacccccuggccaucggcaucuacagagugaagcacaagaugauggacgcccaguuccugaagaaggcccugagacagagauacggcaagaugaccgccgagaaguggaugagcaccaaggugaagaccaucggcgaggccgugagaaacguggagaagcugaaguggggcaagggcggccugagcgacgccgccagaaacuuccugaagaaguucgacaucgccaugaucuga

SEQ ID NO: 5406 - RNA, 705 nt, Artificial Sequence
  derived and/or modified CDS sequence (opt4) from BWAV(M459)__EU564827.1__N
augagcgaccugaucuucuacgacguggacagcgugaacgccaacgaguucgaccccgacaccggcuaccuggacuucaagaacaacuaccccggcgcccugaacaccaacaccgccagaaccuucuuccugaacgccgccaaggccaagaacgugcugagaaacaagcccgacaagaaggugaaccccaaguucggcaacugggagguggagguggugaacaaccacuuccccggcaacagaaacaaccccaucggcaaggacgaccugacccugcacagaaucagcggcuaccuggccagauggauccuggaggaguacaagagagacgacgagagcgagaaggagaucaucgagagcaccgugaucaaccccaucgccgagagcaacggcaucagauggagcgacggcgccgagaucuaccugagcuucuuccccggcaccgagauguuccuggagcccuucaaguucuacccccuggccaucggcaucuacagagugaagcacaagaugauggacgcccaguuccugaagaaggcccugagacagagauacggcaagaugaccgccgagaaguggaugagcaccaaggugaaggccaucggcgaggccgugagaaacguggagaagcugaaguggggcaagggcggccugagcgacgccgccagaaacuuccugaagaaguucgacaucgccaugaucuga

SEQ ID NO: 5407 - RNA, 705 nt, Artificial Sequence
  derived and/or modified CDS sequence (opt4) from BWAV(UgAr1888)__KJ867185.1__N
augagcgaccugaucuucuacgacguggacagcgugaacgccaacgaguucgaccccgacaccggcuaccuggacuucaagaacaacuaccccggcgcccugaacaccaacaccgccagaaccuucuuccugaacgccgccaaggccaagaacgugcugagaaacaagcccgacaagaaggugaaccccaaguucggcaacugggagguggagaucgugaacaaccacuuccccggcaacagaaacaaccccaucggcaaggacgaccugacccugcacagaaucagcggcuaccuggccagauggauccuggaggaguacaagagagacgacgagagcgagaaggagaucaucgagagcaccgugaucaaccccaucgccgagagcaacggcaucagauggagcgacggcgccgagaucuaccugagcuucuuccccggcaccgagauguuccuggagcccuucaaguucuacccccuggccaucggcaucuacagagugaagcacaagaugauggacgcccaguuccugaagaaggcccugagacagagauacggcaagaugaccgccgagaaguggaugagcaccaaggugaaggccaucggcgaggccgugagaaacguggagaagcugaaguggggcaagggcggccugagcgacgccgccagaaacuuccugaagaaguucgacaucgccaugaucuga

SEQ ID NO: 5408 - RNA, 708 nt, Artificial Sequence
  derived and/or modified CDS sequence (opt4) from BWAV/PGAV(SAAr1)__EU564828.1__N
augagcggcgaccugguguucuacgacguggacagcgugaacagcaacgccuucgaccccgacgccggcuacguggccuucagcaacaaccaccccggcgcccugaacaucaccaccgccagaaccuucuuccugaacgccgccaaggccaagggcgugcugagaaacaagcccgacaagaaggugaagcccaaguucggcgacugggagguggagaucgugaacaaccacuuccccggcaacagaaacaacaccaucggcgaggacgaccugacccugcacagaaucagcggcuaccuggccagaugggugcuggaggagcacagcaaggacgacgagagcgagaaggagcugaucgagagcaccaucgugaaccccaucgccgagagcaacggcaucaaguggagcgacggcgccgccaucuaccugagcuucuuccccggcaccgagauguuccuggagcccuucaaguucuucccccuggccaucggcaucuacagagugaagcacaagaugauggacgcccaguuccugaagaaggcccugagacagagauacggcaagcugaccgccgagaaguggauggccaccaaggugaagagcaucggcgaggccgugagagccguggagaagcugaaguggggcaagggcggcaucagcgacgccgccagaaccuuccugaagaaguucgacaucgcccugaucuga

SEQ ID NO: 5409 - RNA, 708 nt, Artificial Sequence; identical to SEQ ID NO: 5408
  derived and/or modified CDS sequence (opt4) from BWAV/PGAV(191B-07)__KJ867179.1__N

SEQ ID NO: 5410 - RNA, 708 nt, Artificial Sequence
  derived and/or modified CDS sequence (opt4) from CEV(283)__KX817314.1__N
augagcgaccugguguucuacgacguggccagcaccggcgccaacggcuucgaccccgacgccggcuacguggacuucugcgccaaguacggcgagagcaucaaccuggccgccgugagaaucuucuuccugaacgccgccaaggccaaggccgcccugagcagaaagcccgagagaaaggccaaccccaaguucggcgaguggcagguggagguggugaacaaccacuuccccgccaacagaaacaaccccaucggcaacaacgaccugaccauccacagaaucagcggcuaccuggccagaugggugcuggagcaguacaaggagaacgaggacgagagccagagagagcuggugaagaccaccgugaucaaccccaucgccgagagcaacggcaucagaugggagaacggcgccgagaucuaccuggccuucuuccccggcaccgagauguuccuggagaccuucaaguucuacccccugaccaucggcaucuacagagugaagaacggcaugauggacagccaguaccugaagaaggcccugagacagagauacggcagccugaccgccgagaaguggaugagccagaagaccggcaugaucgccaagagccugaaggagguggagcagcugaaguggggcagaggcggccugagcgacaccgccagaaccuuccugcagaaguucggcaucaagcugcccuga

SEQ ID NO: 5411 - RNA, 708 nt, Artificial Sequence
  derived and/or modified CDS sequence (opt4) from CEV(BFS-283)__U12797.1__N
augagcgaccugguguucuacgacguggccagcaccggcgccaacggcuucgaccccgacgccggcuacguggacuucugcgccaagcacggcgagagcaucaaccuggccgccgugagaaucuucuuccugaacgccgccaaggccaaggccgcccugagcagaaagcccgagagaaaggccaaccccaaguucggcgaguggcagguggagguggugaacaaccacuuccccgccaacagaaacaaccccaucggcaacaacgaccugaccauccacagaaucagcggcuaccuggccagaugggugcuggagcaguacaaggagaacgaggacgagagccagagagagcuggugaagaccaccgugaucaaccccaucgccgagagcaacggcaucagaugggagaacggcgccgagaucuaccuggccuucuuccccggcaccgagauguuccuggagaccuucaaguucuacccccugaccaucggcaucuacagagugaagaacggcaugauggacagccaguaccugaagaaggcccugagacagagauacggcagccugaccgccgagaaguggaugagccagaagaccggcaugaucgccaagagccugaaggagguggagcagcugaaguggggcagaggcggccugagcgacaccgccagaaccuuccugcagaaguucggcaucaagcugcccuga

SEQ ID NO: 5412 - RNA, 708 nt, Artificial Sequence
  derived and/or modified CDS sequence (opt4) from CHATV(Mohko ILO8-3)__KF719221.1__N
augagcgaccugguguucuacgacguggccagcaccggcgccaacggcuucgaccccgacgagggcuacauggccuucugcgugaagcacgccgagagcaucagccuggccgccgugagaaucuucuuccugaacgccgccaaggccaaggccgcccuggccagaaagcccgagaagaaggccagccccaaguucggcgaguggcagguggagaucgugaacaaccacuuccccggcaacagaaacaaccccaucggcaacaacgaccugaccgugcacagacugagcggcuaccuggccagaugggugcuggagcaguacaaggagaacgaggacgagagccagagagagcugaucaagaccaccgugaucaaccccaucgccgagagcaacggcgugagaugggacagcggccccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5413 - RNA, 708 nt, Artificial Sequence
  derived and/or modified CDS sequence (opt4) from CHATV(Mohko M07-1)__KF719224.1__N
augagcgaccugguguucuacgacguggccagcaccggcgccaacggcuucgaccccgacgagggcuacauggccuucugcgugaagcacgccgagagcaucaaccuggccgccgugagaaucuucuuccugaacgccgccaaggccaaggccgcccuggccagaaagcccgagaagaaggccagccccaaguucggcgaguggcagguggagaucgugaacaaccacuuccccggcaacagaaacaaccccaucggcaacaacgaccugaccgugcacagacugagcggcuaccuggccagaugggugcuggagcaguacaaggagaacgaggacgagagccagagagagcugaucaagaccaccgugaucaaccccaucgccgagagcaacggcgugagaugggacagcggccccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5414 - RNA, 708 nt, Artificial Sequence
  derived and/or modified CDS sequence (opt4) from CHATV(Mohko S07-2)__KF719233.1__N
augagcgaccugguguucuacgacguggccagcaccggcgccaacggcuucgaccccgacgagggcuacauggccuucugcgugaagcacgccgagagcaucaaccuggccgccgugagaaucuucuuccugaacgccgccaaggccaaggccgcccuggccagaaagcccgagaagaaggccagccccaaguucggcgaguggcagguggagaucgugaacaaccacuuccccggcaacagaaacaaccccaucggcaacaacgaccugaccgugcacagacugagcggcuaccuggccagaugggugcuggagcaguacaaggagaacgaggacgagagccagagagagcugaucaagaccaccgugaucaaccccaucgccgagagcaacggcgugagaugggacagcggccccgagaucuaccugagcuucuuccccggcaccgagauguuccuggagaccuucaagguguacccccugaccaccggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5415 - RNA, 708 nt, Artificial Sequence
  derived and/or modified CDS sequence (opt4) from CHATV(LEIV-11483)__FJ853592.1__N
augagcgaccugguguucuacgacguggccagcaccggcgccaacggcuucgaccccgacgagggcuacauggccuucugcgugaagcacggccagagcgugaaccuggccgccgugagaaucuucuuccugaacgccgccaaggccaaggccgcccuggccagaaagcccgagaagaaggccagccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccgugaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5416 - RNA, 708 nt, Artificial Sequence
  derived and/or modified CDS sequence (opt4) from CHATV(LEIV-11552)__EU479702.1__N
augagcgaccugguguucuacgacguggccagcaccggcgccaacggcuucgaccccgacgagggcuacauggccuucugcgugaagcacggccagagcgugaaccuggccgccgugagaaucuucuuccugaacgccgccaaggccaaggccgcccuggccagaaagcccgagaagaaggccagccccaaguucggcgaguggcagguggagaucgugaacaaccacuuccccggcaacagaaacaaccccaucggcaacaacgaccugaccauccacagacugagcggcuaccuggccagauggauccuggagcaguacaaggagaacgaggacgagagccagagagagcugaucaagaccaccgugaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5417 - RNA, 708 nt, Artificial Sequence
  derived and/or modified CDS sequence (opt4) from CHATV(LEIV-13107)__FJ946829.1__N
augagcgaccugguguucuacgacguggccagcaccggcgccaacggcuucgaccccgacgagggcuacauggccuucugcgugaagcacggccagagcgugaaccuggccgccgugagaaucuucuuccugaacgccgccaaggccaaggccgcccuggccagaaagcccgagaagaaggccaaccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccgugaucaaccccaucgccgagagcaacggcgugagaugggacagcggcgccgagguguaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5418 - RNA, 708 nt, Artificial Sequence
  derived and/or modified CDS sequence (opt4) from CHATV(LEIV-17794)__FJ913879.1__N
augagcgaccugguguucuacgacguggccagcaccggcgccaacggcuucgaccccgacgagggcuacauggccuucugcgugaagcacggccagagcgugaaccuggccgccgugagaaucuucuuccugaacgccgccaaggccaaggccgcccuggccagaaagcccgagagaaaggccagccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccgugaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5419 - RNA, 708 nt, Artificial Sequence
  derived and/or modified CDS sequence (opt4) from CHATV(LEIV-17827)__GQ330475.1__N
augagcgaccugguguucuacgacguggccagcaccggcgccaacggcuucgaccccgacgagggcuacauggccuucugcgugaaguacggcgagagcaucaaccuggccgccgugagaaucuucuuccugaacgccgccaaggccaaggccgcccuggccagaaagcccgagaagaaggccaaccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccaucaucaaccccaucgccgagagcaacggcgugagaugggagagcggcgccgagguguaccugagcuucuuccccggcaccgagauguuccuggagaucuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5420 - RNA, 708 nt, Artificial Sequence
  derived and/or modified CDS sequence (opt4) from CHATV(LEIV-17829)__GQ330476.1__N
augagcgaccugguguucuacgacguggccagcaccggcgccaacggcuucgaccccgacgagggcuacauggccuucugcgugaaguacggcgagagcaucaaccuggccgccgugagaaucuucuuccugaacgccgccaaggccaaggccgcccuggccagaaagcccgagaagaaggccaaccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccaucaucaaccccaucgccgagagcaacggcgugagaugggacagcggcgccgagguguaccugagcuucuuccccggcaccgagauguuccuggagaucuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5421 - RNA, 708 nt, Artificial Sequence
  derived and/or modified CDS sequence (opt4) from CHATV(LEIV-18733)__HQ734824.1__N
augagcgaccugguguucuacgacguggccagcaccggcgccaacggcuucgaccccgacgagggcuacauggccuucugcgugaaguacggcgagagcaucaaccuggccgccgugagaaucuucuuccugaacgccgccaaggccaaggccgcccuggccagaaagcccgagaagaaggccaaccccaaguucggcgaguggcagguggagaucaucaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccaucaucaaccccaucgccgagagcaacggcgugagaugggacagcggcgccgagguguaccugagcuucuuccccggcaccgagauguuccuggagaucuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5422 - RNA, 708 nt, Artificial Sequence
  derived and/or modified CDS sequence (opt4) from CHATV(LEIV-18895)__GQ330482.1__N
augagcgaccugguguucuacgacguggccagcaccggcgccaacggcuucgaccccgacgagggcuacauggccuucugcgugaaguacggcgagagcaucaaccuggccgccgugagaaucuucuuccugaacgccgccaaggccaaggccgcccuggccagaaagcccgagagaaaggccaaccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccaucaucaaccccaucgccgagagcaacggcgugagaugggacagcggcgccgagguguaccugagcuucuuccccggcaccgagauguuccuggagaucuucaaguucuacccccugaccaucggcaucuacagagugaagcagggccugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5423 - RNA, 708 nt, Artificial Sequence
  derived and/or modified CDS sequence (opt4) from CHATV(LEIV-22712)__HQ734825.1__N
augagcgaccugguguucuacgacguggccagcaccggcgccaacggcuucgaccccgacgagggcuacauggccuucugcgugaagcacggcgagagcaucaaccuggccgccgugagaaucuucuuccugaacgccgccaaggccaaggccgcccuggccagaaagcccgagaagaaggccagccccaaguucggcgaguggcagguggagaucaucaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccgugaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5424 - RNA, 708 nt, Artificial Sequence
  derived and/or modified CDS sequence (opt4) from CHATV(LEIV-23500)__EU479701.1__N
augagcgaccugguguucuacgacguggccagcaccggcgccaacggcuucgaccccgacgccggcuacauggccuucugcgugaagcacggcgagagcaucaaccuggccgccgugagaaucuucuuccugaacgccgccaaggccaaggccgcccuggccagaaagcccgagaagaaggccaaccccaaguucggcgaguggcagguggagaucgugaacaaccacuuccccggcaacagaaacaaccccaucggcaacaacgaccugaccauccacagacugagcggcuaccuggccagaugggugcuggagcaguacaaggagaacgaggacgagagccagagagagcugaucaagaccaccgugaucaaccccaucgccgagagcaacggcgugagaugggagaacggcgccgagguguaccugagcuucuuccccggcaccgagauguuccuggagaccuucaaguucuacccccugaccaucggcaucuacagagugaagcagggcaugauggacccccaguaccugaagaaggcccugagacagagauacggcacccugaccgccgacaaguggaugagccagaaggugaccgccaucgccaagagccugaaggagguggagcagcugaaguggggcagaggcggccugagcgacaccgccagaaccuuccugcagaaguucggcaucagacugcccuga

SEQ ID NO: 5425 - RNA, 708 nt, Artificial Sequence
  derived and/or modified CDS sequence (opt4) from INKV__Z68496.1__N
augggcgaccugguguucuacgacgaggccagcaccggcgccaacggcuucgaccccgacgccggcuucguggccuucauggccgaccacggcgagagcaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuucuuccccggcaccgagauguuccuggagguguucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5426 - RNA, 708 nt, Artificial Sequence
  derived and/or modified CDS sequence (opt4) from INKV(KN3641)__U47137.1__N
augggcgaccugguguucuacgacguggccagcaccggcgccaacggcuucgaccccgacgccggcuucguggccuucauggccgaccacggcgagagcaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuucuuccccggcaccgagauguuccuggagguguucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5427 - RNA, 708 nt, Artificial Sequence
  derived and/or modified CDS sequence (opt4) from INKV(Lovanger)__KU302751.1__N
augggcgaccugguguucuacgacguggccagcaccggcgccaacggcuucgaccccgacgccggcuucguggccuucauggccgaccacggcgagagcaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuucuuccccggcaccgagauguuccuggagguguucaaguucuacccccugaccaucggcaucuacagagugaagcacggcaugauggacccccaguaccugaagaaggcccugagacagagauacggcacccugaccgccgagaaguggaugacccagaagaccgugcugaucgccaagagccugaaggacguggagcagcugaaguggggcagaggcggccugagcgacgccgccagaaccuuccugaucaaguucggcgugaagcugcccuga

SEQ ID NO: 5428 - RNA, 708 nt, Artificial Sequence
  derived and/or modified CDS sequence (opt4) from INKV(SW AR 83-161)__U47138.1__N
augggcgaccugguguucuacgacguggccagcaccggcgccaacggcuucgaccccgacgccggcuucguggccuucauggccgaccacggcgagagcaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuuccugcccggcaccgagauguuccuggagguguucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5429 - RNA, 708 nt, Artificial Sequence
  derived and/or modified CDS sequence (opt4) from LUMV__X73468.1__N
augagcgaccugguguucuacgacguggccagcaccggcgccaacggcuucgaccccgacgccggcuacguggacuucugcgugaagcacggcgagagcaucaaccugcacagcgugagaaucuucuuccugaacgccgccaaggccaaggccgcccuggccagaaagcccgagagaaaggccagccccaaguucggcgaguggcagguggagaucgugaacaaccacuuccccggcaacagaaacaaccccaucgacaacaacgaccugaccauccacagacugagcggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcacggcaugauggacccccaguaccugaagaaggcccugagaagaagauacggcagccugaccgccgacaaguggaugagccagaagaccguggccaucgccaagagccugaaggacguggagcagcugaaguggggcagaggcggccugagcgacaccgccagaguguuccugcagaaguucggcaucaagcugcccuga

SEQ ID NO: 5430 - RNA, 708 nt, Artificial Sequence
  derived and/or modified CDS sequence (opt4) from LUMV(SAAr 1881)__KX817326.1__N
augagcgaccugguguucuacgacguggccagcaccggcgccaacggcuucgaccccgacgccggcuacguggacuucugcgugaagcacggcgagagcaucaaccugcacagcgugagaaucuucuuccugaacgccgccaaggccaaggccgcccuggccagaaagcccgagagaaaggccagccccaaguucggcgaguggcagguggagaucgugaacaaccacuuccccggcaacagaaacaaccccaucgacaacaacgaccugaccauccacagacugagcggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcacggcaugauggacccccaguaccugaagaaggcccugagacagagauacggcagccugaccgccgacaaguggaugagccagaagaccguggccaucgccaagagccugaaggacguggagcagcugaaguggggcagaggcggccugagcgacaccgccagaguguuccugcagaaguucggcaucaagcugcccuga

SEQ ID NO: 5431 - RNA, 708 nt, Artificial Sequence
  derived and/or modified CDS sequence (opt4) from MELV(TRVL 9375)__KX817329.1__N
augggcgaccugaucuucuacgacguggccagcaccggcgccaacggcuucgaccccgacgccggcuaccuggccuucaccaucgcccacggcgaggccaucaaccugagcgccgugagaaucuucuuccugaacgccgccaaggccaaggccgcccugagcagaaagcccgagagaaaggccacccccaaguucggcgacuggcagguggagaucgugaacaaccacuuccccggcaacagaaacaaccccaucggcaacaacgaccugaccauccacagacugagcggcuaccuggccagaugggugcuggaccuguucaaggagaacgaggacgagagccagaaggagcugauccagagcaccaucaucaaccccaucgccgagagcaacggcauccacugggccaacggcguggagaucuaccugagcuucuuccccggcaccgagauguuccuggaggccuucagauucuacccccugaccaucggcaucuacagagugaagcacggccugauggacccccaguaccugaagaaggcccugagacagagauacggcacccugaccgccgacaaguggauggcccagaagaccaccaugaucgccaagagccugaaggacguggagcagcugaaguggggcaagggcggccugagcgacgccgccagaaccuuccugcagaaguucggcgugagacugcccuga

SEQ ID NO: 5432 - RNA, 708 nt, Artificial Sequence
  derived and/or modified CDS sequence (opt4) from MBV__U31989.1__N
augagcgaccugguguucuacgacguggccagcaccggcgccaacggcuucgaccccgacgccggcuacguggacuucugcgccaagcacggcgagagcaucaaccuggccgccgugagaaucuucuuccugaacgccgccaaggccaaggccgcccugagcagaaagcccgagagaaaggccaaccccaaguucggcgaguggcagguggagaucgugaacaaccacuuccccgccaacagaaacaaccccaucggcaacaacgaccugaccauccacagaaucagcggcuaccuggccagaugggugcuggagcaguacagagagaacgaggacgagagccagagagagcuggugaagaccaccgugaucaaccccaucgccgagagcaacggcaucagaugggagaacggccccgagaucuaccuggccuucuuccccggcaccgagauguuccuggagaccuucaaguucuacccccugaccaucggcaucuacagagugaagcacggcaugauggacccccaguaccugaagaaggcccugagacagagauacggcagccugaccgccgagaaguggaugagccagaagaccggcaugaucgccaagagccugaaggagguggagcagcugaaguggggcagaggcggccugagcgacaccgccagaaccuuccugcagaaguucggcaucagacugcccuga

SEQ ID NO: 5433 - RNA, 708 nt, Artificial Sequence
  derived and/or modified CDS sequence (opt4) from SAV(VR723)__U47139.1__N
augagcgagcugguguucuacgacguggccagcaccggcgccaacggcuucgaccccgacgccggcuaccuggccuucugcgugaagcacggcgagagcaucagccugagcagcgugagaaucuucuuccugaacgccgccaaggccaaggccgcccugagcagaaagcccgagagaaaggccaaccccaaguucggcgaguggcagguggagaucgugaacaaccacuuccccggcaacagaaacaaccccaucgacaaccuggaccugaccauccacagacugagcggcuaccuggccagaugggugcuggagcaguucaucgagaacgaggacgagagccagagagagcugaucaagaccaccgugaucaaccccaucgccgagagcaacggcaucaagugggagaacggcgccgagaucuaccugagcuucuuccccggcaccgagauguuccuggagaucuucaaguucuacccccugaccaucggcaucuacagagugaagcagggcaugauggacccccaguaccugaagaaggcccugagacagagauacggcagccugaccgccgacaaguggaugagccagaaggugggcgccaucgccaagagccugaaggacaucgagcagcugaaguggggcaagggcggccugagcgacaccgccagaaccuuccugcagaaguucggcaucaagcugcccuga

SEQ ID NO: 5434 - RNA, 708 nt, Artificial Sequence
  derived and/or modified CDS sequence (opt4) from SDNV(BeAr 103645)__U47140.1__N
augggcgaccugguguucuacgacguggccagcaccggcgccaacggcuucgaccccgacgccggcuucguggccuucauggccggccacggcgagagcaucaaccugaccgccgugagaaucuucuuccugaacgccgccaaggccaaggccgcccugagcagaaagcccgagagaaaggccacccccaaguucggcgacuggcagguggagaucgugaacaaccacuuccccggcaacagaaacaaccccaucggcaacaacgaccugaccauccacagaaucagcggcuaccuggccagauggacccuggagcacuucagagagggcggcgacgaggcccagaaggagcugaucagaaccaccaucaucaaccccaucgccgagagcaacggcauccacugggccaacggcgccgagaucuaccugagcuucuuccccggcaccgagauguuccuggaggccuucaaguucuacccccugaccaucggcaucuacagagugaagcacggcaugauggacgcccaguaccugaagaaggcccugagacagagauacggcacccugaccgccgacgaguggauggcccagaagaccgugcugaucaccaagagccugaaggacguggagcagcugaaguggggcagaggcggccugagcgacgccgccagaaccuuccugagcaaguucggcgugaagcugcccuga

SEQ ID NO: 5435 - RNA, 708 nt, Artificial Sequence
  derived and/or modified CDS sequence (opt4) from SDNV(BeAr 103645)__KX817335.1__N
augggcgaccugguguucuacgacguggccagcaccggcgccaacggcuucgaccccgacgccggcuucguggccuucauggccggccacggcgagagcaucaaccugaccgccgugagaaucuucuuccugaacgccgccaaggccaaggccgcccugagcagaaagcccgagagaaaggccacccccaaguucggcgacuggcagguggagaucgugaacaaccacuuccccggcaacagaaacaaccccaucggcaacaacgaccugaccauccacagaaucagcggcuaccuggccagauggacccuggagcacuucagagagggcgaggacgaggcccagaaggagcugaucagaaccaccaucaucaaccccaucgccgagagcaacggcauccacugggccaacggcgccgagaucuaccugagcuucuuccccggcaccgagauguuccuggaggccuucaaguucuacccccugaccaucggcaucuacagagugaagcacggcaugauggacgcccaguaccugaagaaggcccugagacagagauacggcacccugaccgccgacaaguggauggcccagaagaccgugcugaucaccaagagccugaaggacguggagcagcugaaguggggcagaggcggccugagcgacgccgccagaaccuuccugagcaaguucggcgugaagcugcccuga

SEQ ID NO: 5436 - RNA, 708 nt, Artificial Sequence
  derived and/or modified CDS sequence (opt4) from SSHV__EU294510.1__N
augagcgaccugguguucuacgacguggccagcaccggcgccaacggcuucgaccccgacgccggcuacauggccuucugcgugaaguacgccgagagcgugaaccuggccgccgugagaaucuucuuccugaacgccgccaaggccaaggccgcccugagcagaaagcccgagagaaaggccaaccccaaguucggcgaguggcagguggagguggugaacaaccacuuccccggcaacagaaacaaccccaucaacagcgacgaccugaccauccacagacugagcggcuaccuggccagaugggugcuggagcaguacaaggagaacgaggacgagagcagaagagagcugaucaagaccaccaucaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcagccugaccgccgacaaguggaugagccagaaggugaccgccaucgccaagagccugaaggagguggagcagcugaaguggggcagaggcggccugagcgacaccgccagaagcuuccugcagaaguucggcaucagacugcccuga

SEQ ID NO: 5437 - RNA, 708 nt, Artificial Sequence
  derived and/or modified CDS sequence (opt4) from SSHV(F10838)__KM215563.1__N
augagcgaccugguguucuacgacguggccagcaccggcgccaacggcuucgaccccgacgccggcuacauggccuucugcgugaaguacgccgagagcgugaaccuggccgccgugagaaucuucuuccugaacgccgccaaggccaaggccgcccugagcagaaagcccgagagaaaggccaaccccaaguucggcgaguggcagguggagguggugaacaaccacuuccccggcaacagaaacaaccccaucaacagcgacgaccugaccauccacagacugagcggcuaccuggccagaugggugcuggagcaguacaaggagaacgaggacgagagcagaagagagcugaucaagaccaccaucaucaaccccaucgccgagagcaacggcgugagaugggacagcggcgccgagaucuaccugagcuucuuccccggcaccgagauguuccuggagaccuucaaguucuacccccugaccaucggcaucuacagagugaagcagggcaugauggacccccaguaccugaagaaggcccugagacagagauacggcagccugaccgccgacaaguggaugagccagaaggugaccgccaucgccaagagccugaaggagguggagcagcugaaguggggcagaggcggccugagcgacaccgccagaagccugcugcagaaguucggcaucagacugcccuga

SEQ ID NO: 5438 - RNA, 708 nt, Artificial Sequence
  derived and/or modified CDS sequence (opt4) from SORV(SORV-252)__GU018050.2__N
augggcgaccugguguucuacgacguggccagcaccggcgccaacggcuucgaccccgacgccggcuucguggccuucauggccgaccacggcgagagcaucagccugagcgccgugagaaucuucuuccugaacgccgccaaggccaaggccgcccuggccagaaagcccgagagaaaggccaaccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgaggacgagagccagagagagcugaucagaagcaccaucaucaaccccaucgccgagagcaacggcaucagauggaacaacggccccgagaucuaccugagcuucuuccccggcaccgagauguuccuggaggccuucaaguucuacccccugaccaucggcaucuacagagugaagcacggccugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5439 - RNA, 708 nt, Artificial Sequence
  derived and/or modified CDS sequence (opt4) from SORV(NJO 94F)__U47141.1__N
augggcgaccugguguucuacgacguggccagcaccggcgccaacggcuucgaccccgacgccggcuucguggccuucauggccgaccacggcgagagcaucaaccugagcgccgugagaaucuucuuccugaacgccgccaaggccaaggccgcccuggccagaaagcccgagagaaaggccaaccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgaggacgagagccagagagagcugaucagaagcaccaucaucaaccccaucgccgagagcaacggcauccacuggaacaacggccccgagaucuaccugagcuucuuccccggcaccgagauguuccuggaggccuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5440 - RNA, 708 nt, Artificial Sequence
  derived and/or modified CDS sequence (opt4) from SORV(NJO-94F)__KX817338.1__N
augggcgaccugguguucuacgacguggccagcaccggcgccaacggcuucgaccccgacgccggcuucguggccuucauggccgaccacggcgagagcaucaaccugagcgccgugagaaucuucuuccugaacgccgccaaggccaaggccgcccuggccagaaagcccgagagaaaggccaaccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgaggacgagagccagagagagcugaucagaagcaccaucaucaaccccaucgccgagagcaacggcauccacuggaacaacggccccgagaucuaccugagcuucuuccccggcaccgagauguuccuggaggccuucaaguucuacccccugaccaucggcaucuacagagugaagcacggccugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5441 - RNA, 708 nt, Artificial Sequence
  derived and/or modified CDS sequence (opt4) from TAHV__Z68497.1__N
augagcgaccugguguucuacgacguggccagcaccggcgccaacggcuucgaccccgacgccggcuacguggacuucugcaucaagcacggcgaggccaucaaccugcacagcgugagaaucuucuuccugaacgccgccaaggccaaggccgcccuggccagaaagcccgagagaaaggccagccccaaguucggcgaguggcagguggagguggugaacuaccacuuccccggcaacagaaacaaccccaucgacaacaacgaccugaccauccacagacuguacggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcagggcaugauggacccccaguaccugaagaaggcccugagacagagauacggcagccugaccgccgacaaguggaugagccagaagaccaccgccaucgccaagagccugaaggacguggagcagcugaaguggggcagaggcggccugagcgacaccgccagaaccuuccugcagaaguucggcaucagacugcccuga

SEQ ID NO: 5442 - RNA, 708 nt, Artificial Sequence
  derived and/or modified CDS sequence (opt4) from TAHV(22595-6)__HM036217.1__N
augagcgaccugguguucuacgacguggccagcaccggcgccaacggcuucgaccccgacgccggcuacguggacuucugcaucaagcacggcgaggccaucaaccugcacagcgugagaaucuucuuccugaacgccgccaaggccaaggccgcccuggccagaaagcccgagagaaaggccagccccaaguucggcgaguggcagguggagguggugaacaaccacuuccccggcaacagaaacaaccccaucgacaacaacgaccugaccauccacagacugagcggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcagggcaugauggacccccaguaccugaagaaggcccugagacagagauacggcagccugaccgccgacaaguggaugagccagaagaccaccgccaucgccaagagccugaaggacguggagcagcugaaguggggcagaggcggccugagcgacaccgccagaaccuuccugcagaaguucggcaucagacugcccuga

SEQ ID NO: 5443 - RNA, 708 nt, Artificial Sequence
  derived and/or modified CDS sequence (opt4) from TAHV(NM08003)__HQ541823.1__N
augagcgaccugguguucuacgacguggccagcaccggcgccaacggcuucgaccccgacgccggcuacguggacuucugcaucaagcacggcgaggccaucaaccugcacagcgugagaaucuucuuccugaacgccgccaaggccaaggccgcccuggccagaaagcccgagagaaaggccagccccaaguucggcgaguggcagguggagguggugaacaaccacuuccccggcaacagaaacaaccccaucgacaacaacgaccugaccauccacagacugagcggcuaccuggccagaugggugcuggagcaguucaaggagaacgacgacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcagggcaugauggacccccaguaccugaagaaggcccugagacagagauacggcagccugaccgccgacaaguggaugagccagaagaccaccgccaucgccaagagccugaaggacguggagcagcugaaguggggcagaggcggccugagcgacaccgccagaaccuuccugcagaaguucggcaucagacugcccuga

SEQ ID NO: 5444 - RNA, 708 nt, Artificial Sequence
  derived and/or modified CDS sequence (opt4) from TAHV(XJ0625)__EU622820.2__N
augagcgaccugguguucuacgacguggccagcaccggcgccaacggcuucgaccccgacgccggcuacguggacuucugcgugaaguacggcgaggccaucaaccugcacagcgugagaaucuucuuccugaacgccgccaaggccaaggccgcccuggccagaaagcccgagagaaaggccagccccaaguucggcgaguggcagguggagguggugaacaaccacuuccccggcaacagaaacaaccccaucgacaacaacgaccugaccauccacagacugagcggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcagggcaugauggacccccaguaccugaagaaggcccugagacagagauacggcccccugaccgccgacaaguggaugagccagaagaccguggccaucgccaagagccugaaggacguggagcagcugaaguggggcagaggcggccugagcgacaccgccagaaccuuccugcagaaguucggcaucagacugcccuga

SEQ ID NO: 5445 - RNA, 708 nt, Artificial Sequence
  derived and/or modified CDS sequence (opt4) from TAHV(XJ0708)__HM243139.1__N
augagcgaccugguguucuacgacguggccagcaccggcgccaacggcuucgaccccgacgccggcuacguggacuucugcgccaaguacggcgaggccaucaaccugcacagcgugagaaucuucuuccugaacgccgccaaggccaaggccgcccuggccagaaagcccgagagaaaggccagccccaaguucggcgaguggcagguggagguggugaacaaccacuuccccggcaacagaaacaaccccaucgacaacaacgaccugaccauccacagacugagcggcuaccuggccagaugggugcuggagcaguucaaggagaacgaggacgccgcccagagagagcugaucaagaccaccgugaucaaccccaucgccgagagcaacggcaucagaugggacaacggcgccgagaucuaccuggccuucuuccccggcaccgagauguuccuggagaccuucaacuucuacccccugaccaucggcaucuacagagugaagcagggcaugauggacccccaguaccugaagaaggcccugagacagagauacggcccccugaccgccgacaaguggaugagccagaagaccguggccaucgccaagagccugaaggacguggagcagcugaaguggggcagaggcggccugagcgacaccgccagaaccuuccugcagaaguucggcaucagacugcccuga

SEQ ID NO: 5446 - RNA, 708 nt, Artificial Sequence
  derived and/or modified CDS sequence (opt4) from TVTV(AR42)__KX891323.1__N
augagcgagcugguguucuacgacgcccccagcaccggcgccaacggcuucgaccccgacgccggcuacguggccuucaucgccgcccacgccggcagcuacgaccugagcgccgugagaaucuucuuccugaacgccgccaaggccaagaacgcccugagcagaaagcccgagggcaaggugagcaucaaguucggcgaguggagcguggagguggugaacaaccacuuccccggcaacagaaacaaccccaucggcaacaacgaccugaccauccacagaaucagcggcuaccuggccagaugggugcuggaggaguucaagggccaggacgacgaggcccagaaggacaucaucagaagcaccaucgugaaccccaucgccgagagcaacggcauccacugggacagcggcgccgacgccuaccugagcuucuuccccggcaccgagauguuccuggagagcuucgacuuccugccccuggccaucggcaucuacagagugaagaacggcaugauggacgugcaguaccugaagaaggcccugagacagagauacggcaccaugaccgccgacaaguggaugagcaccaagaccaccgugaucgccaagacccugaagagaguggagagcuucaaguggggcaagggcggccugagcgaggccgccagagccuuccugagcaaguucaacgugaagauccccuga

SEQ ID NO: 5447 - RNA, 708 nt, Artificial Sequence
  derived and/or modified CDS sequence (opt4) from TVTV(ND3374)__KM215564.1__N
augagcgagcugguguucuacgacgcccccagcaccggcgccaacggcuucgaccccgacgccggcuacguggccuucaucgccgcccacgccggcagcuacgaccugagcgccgugagaaucuucuuccugaacgccgccaaggccaagaacgcccugagcagaagacccgagggcaaggugagcaucaaguucggcgaguggagcguggagguggugaacaaccacuuccccggcaacagaaacaaccccaucggcaacaacgaccugaccauccacagaaucagcggcuaccuggccagaugggugcuggaggaguucaagggccaggacgacgaggcccagaaggacaucaucagaagcaccaucgugaaccccaucgccgagagcaacggcauccacugggacagcggcgccgacgccuaccugagcuucuuccccggcaccgagauguuccuggagagcuucgacuuccugccccuggccaucggcaucuacagagugaagaacggcaugauggacgugcaguaccugaagaaggcccugagacagagauacggcaccaugaccgccgacaaguggaugagcaccaagaccaccgugaucgccaagacccugaagagaguggagagcuucaaguggggcaagggcggccugagcgaggccgccagagccuuccugagcaaguucaacgugaagauccccuga

SEQ ID NO: 5448 - RNA, 708 nt, Artificial Sequence
  derived and/or modified CDS sequence (opt4) from JCV(3324-04)__HM007356.1__N
augggcgaccugguguucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5449 - RNA, 708 nt, Artificial Sequence
  derived and/or modified CDS sequence (opt4) from JCV(61v2235)__U12796.1__N
augggcgaccugguguucuacgacguggccagcaccggcgccaacggcuucgaccccgacgccggcuucguggccuucauggccgaccacggcgagagcaucaaccugagcgccgugagaaucuucuuccugaacgccgccaaggccaaggccgcccuggccagaaagcccgagagaaaggccacccccaaguucggcgaguggcagguggagaucgugaacaaccacuucagcggcaacagaaacaaccccaucggcaacaacgaccugaccauccacagacugagcggcuaccuggccagaugggugcuggagcacuucaacagcgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5450 - RNA, 708 nt, Artificial Sequence
  derived and/or modified CDS sequence (opt4) from JCV(1064-03)__EF681816.1__N
augggcgaccugguguucuacgacguggccagcaccggcgccaacggcuucgaccccgacgccggcuucguggccuucauggccgaccacggcgaggccaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuucuuccccggcaccgagauguuccuggagguguucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5451 - RNA, 708 nt, Artificial Sequence
  derived and/or modified CDS sequence (opt4) from JCV(33909)__EF681853.1__N
augggcgaccugguguucuacgacguggccagcaccggcgccaacggcuucgaccccgacgccggcuucguggccuucauggccgaccacggcgaggugaucaaccuggccgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccgaggacgacgacgagagccagagagagcugaucagaagcaccaucaucaaccccaucgccgagagcaacggcauccacuggaacaacggccccgagaucuaccugagcuucuuccccggcaccgagauguuccuggagguguucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5452 - RNA, 708 nt, Artificial Sequence
  derived and/or modified CDS sequence (opt4) from JCV(2179-00)__EF681808.1__N
augggcgaccugguguucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcauccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5453 - RNA, 708 nt, Artificial Sequence
  derived and/or modified CDS sequence (opt4) from JCV(2989-06)__EF681849.1__N
augggcgaccugaucuucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5454 - RNA, 708 nt, Artificial Sequence
  derived and/or modified CDS sequence (opt4) from JCV(5592-02)__EF681804.1__N
augggcgaccugguguucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacagccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5455 - RNA, 708 nt, Artificial Sequence
  derived and/or modified CDS sequence (opt4) from JCV(F5609)__KM215546.1__N
augggcgaccugguguucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaccaaguucggcgugaagcugcccuga

SEQ ID NO: 5456 - RNA, 708 nt, Artificial Sequence
  derived and/or modified CDS sequence (opt4) from JCV(F6577)__KM215557.1__N
augggcgaccugguguucuacgacguggccagcaccggcgccaacggcuucgaccccgacgccggcuucguggccuucauggccgaccacggcgagagcgugagccugagcgccgugagaaucuucuuccugaacgccgccaaggccaaggccgcccugagcagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5457 - RNA, 708 nt, Artificial Sequence
  derived and/or modified CDS sequence (opt4) from JCV(W13135)__KM215552.1__N
augggcgaccugguguucuacgacguggccagcaccggcgccaacggcuucgaccccgacgccggcuucguggccuucauggccgaccacggcgagagcgugaaccugagcgccgugagaaucuucuuccugaacgccgccaaggccaaggccgcccuggccagaaagcccgagagaaaggccacccccaaguucggcgaguggcagguggagaucgugaacaaccacuuccccggcaacagaaacaaccccaucggcaacaacgaccugaccauccacagacugagcggcuaccuggccagaugggugcuggagcacuucaccaccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5458 - RNA, 708 nt, Artificial Sequence
  derived and/or modified CDS sequence (opt4) from JCV(W18393)__KM215559.1__N
augggcgaccugguguucuacgacguggccagcaccggcgccaacggcuucgaccccgacgccggcuucguggccuucauggccgaccacggcgagagcaucaaccugagcgccgugagaaucuucuuccugaacgccgccaaggccaaggccgcccuggccagaaagcccgagagaaaggccacccccaaguucggcgaguggcagguggagaucaucaacaaccacuuccccggcaacagaaacaaccccaucggcaacaacgaccugaccauccacagacugagcggcuaccuggccagaugggugcuggagcacuucaccgccgacgacgacgagagccagagagagcugaucagaagcaccaucaucaaccccaucgccgagagcaacggcauccacuggaacaacggccccgagaucuaccugagcuucuuccccggcaccgagauguuccuggagaucuucaaguucuacccccugaccaucggcaucuacagagugaagcacggcaugauggacccccaguaccugaagaaggcccugagacagagauacggcacccugaccgccgagaaguggauggcccagaagaccgugcugaucgccaagagccugaaggacguggagcagcugaaguggggcagaggcggccugagcgacgccgccagaaccuuccugaucaaguucggcgugaagcugcccuga

SEQ ID NO: 5459 - RNA, 708 nt, Artificial Sequence
  derived and/or modified CDS sequence (opt4) from KEYV(KEYV/Ochlerotatus atlanticus/USA/KEYVLK01/2005)__KT630290.1__N
augggcgaccugguguucuacgacguggccagcaccggcgccaacggcuucgaccccgacgccggcuacguggccuucauggccaaccacggcgagagcaucagccugagcaccgugagaaucuucuuccugaacgccgccaaggccaaggccgcccugaccagaaagcccgagagaaaggccacccccaaguucggcgaguggcagguggagaucgugaacaaccacuuccccggcaacagaaacaaccccaucggcaacaacgaccugacccugcacagaaucagcggcuaccuggccagaugggugcuggagcacuucggcgagggcgaggacgagagccagaaggagcugaucaagagcaccgugaucaaccccaucgccgagagcaacggcaucagauggggcaacggcguggagaucuaccugagcuucuuccccggcaccgagauguuccuggagcuguucaaguucuacccccugaccaucggcaucuacagagugaagcacggcaugauggacgcccaguaccugaagaaggcccugagacagagauacggcacccugaccgccgacaaguggauggcccagaagaccagcaugaucaccaagagccugaaggacguggagcagcugaaguggggcaagggcggccugagcgacaccgccagagccuuccuggccaaguucggcgugagacugcccuga

SEQ ID NO: 5460 - RNA, 708 nt, Artificial Sequence
  derived and/or modified CDS sequence (opt4) from KEYV(KEYV/Ochlerotatus atlanticus/USA/KEYVLK02/2005)__KT630293.1__N
augggcgaccugguguucuacgacguggccagcaccggcgccaacggcuucgaccccgacgccggcuacguggccuucauggccaaccacggcgagagcaucagccugagcaccgugagaaucuucuuccugaacgccgccaaggccaaggccgcccugaccagaaagagcgagagaaaggccacccccaaguucggcgaguggcagguggagaucgugaacaaccacuuccccggcaacagaaacaaccccaucggcaacaacgaccugacccugcacagaaucagcggcuaccuggccagaugggugcuggagcacuucggcgagggcgaggacgagagccagaaggagcugaucaagagcaccgugaucaaccccaucgccgagagcaacggcaucagauggggcaacggcguggagaucuaccugagcuucuuccccggcaccgagauguuccuggagcuguucaaguucuacccccugaccaucggcaucuacagagugaagcacggcaugauggacgcccaguaccugaagaaggcccugagacagagauacggcacccugaccgccgacaaguggauggcccagaagaccagcaugaucaccaagagccugaaggacguggagcagcugaaguggggcaagggcggccugagcgacaccgccagagccuuccuggccaaguucggcgugagacugcccuga

SEQ ID NO: 5461 - RNA, 708 nt, Artificial Sequence; identical to SEQ ID NO: 5459
  derived and/or modified CDS sequence (opt4) from KEYV(C14031-33)__U12801.1__N

SEQ ID NO: 5462 - RNA, 708 nt, Artificial Sequence
  derived and/or modified CDS sequence (opt4) from LACV(Human/78)__NC_004110.1__N
augagcgaccugguguucuacgacguggccagcaccggcgccaacggcuucgaccccgacgccggcuacauggacuucugcgugaagaacgccgagcugcugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagcacgagcugaucagaaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5463 - RNA, 708 nt, Artificial Sequence
  derived and/or modified CDS sequence (opt4) from LACV__KP271107.1__N
augagcgaccugguguucuacgacguggccagcaccggcgccaacggcuucgaccccgacaccggcuacauggacuucugcgugaagaacgccgagagccugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagcacgagcugaucagaaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5464 - RNA, 708 nt, Artificial Sequence
  derived and/or modified CDS sequence (opt4) from LACV(BEN2_Lafayette_WI_2007)__GU596386.1__N
augagcgaccugguguucuacgacguggccagcaccggcgccaacggcuucgaccccgacgccggcuacauggacuucugcgugaagaacgccgagagccugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagcacgagcugaucagaaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5465 - RNA, 708 nt, Artificial Sequence
  derived and/or modified CDS sequence (opt4) from LACV(Dallas/TX/2009)__GU591164.1__N
augagcgaccugguguucuacgacguggccagcaccggcgccaacggcuucgaccccgacgccggcuacauggacuucugcgugaagaacgccgagagccugaaccuggccgccgugagaaucuucuuccugaacgccgccaaggccaaggccgcccugagcagaaagcccgagagaaaggccaaccccaaguucggcgaguggcagguggagguggugaacaaccacuuccccggcaacagaaacaaccccaucggcaacaacgaccugaccauccacagacugagcggcuaccuggccagaugggugcuggaccaguacaacgagaacgacgacgagagccagagagagcugaucagaaccaccaucaucaaccccaucgccgagagcaacggcgugagaugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5466 - RNA, 708 nt, Artificial Sequence
  derived and/or modified CDS sequence (opt4) from LACV(Fort Bend County/TX/2009)__GU591167.1__N
augagcgaccugguguucuacgacguggccagcaccggcgccaacggcuucgaccccgacgccggcuacauggacuucugcgugaagaacgccgagagccugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagagagagcugaucagaaccaccaucaucaaccccaucgccgagagcaacggcgugagaugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5467 - RNA, 708 nt, Artificial Sequence
  derived and/or modified CDS sequence (opt4) from LACV(LACV/95/OH-H (CCH-MB96))__GU206135.1__N
augagcgaccugguguucuacgacguggccagcaccggcgccaacggcuucgaccccgacgccggcuacauggacuucugcgugaagaacgccgagagccugaaccuggccgccgugagaaucuucuuccugaacgccgccaaggccaaggccgcccugagcagaaagcccgagagaaaggccaaccccaaguucggcgaguggcagguggagguggugaacaaccacuuccccggcaacagaaacaaccccaucggcaacaacgaccugaccauccacagacugagcggcuaccuggccagaugggugcuggaccaguacaacgagaacgacgacgagagccagcacgagcugaucaagaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccuga

SEQ ID NO: 5468 - RNA, 696 nt, Artificial Sequence
  derived and/or modified CDS sequence (opt4) from OROV(BeAn19991)__NC_005777.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5469 - RNA, 696 nt, Artificial Sequence
  derived and/or modified CDS sequence (opt4) from OROV(AR136921)__HQ830443.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5470 - RNA, 696 nt, Artificial Sequence
  derived and/or modified CDS sequence (opt4) from OROV(AR366927)__HQ830448.1__N
augagcgaguucuucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagaaguacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5471 - RNA, 696 nt, Artificial Sequence
  derived and/or modified CDS sequence (opt4) from OROV(BeAn 206119)__AY993909.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccgccgugguggugccccugguggaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgagaccgugggcaccuucgccugggccagaaccggcuucagccccgccgccagagacuuccugagacaguucggcaucggcaucuga

SEQ ID NO: 5472 - RNA, 696 nt, Artificial Sequence
  derived and/or modified CDS sequence (opt4) from OROV(BeAn 208819)__AY993911.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccugguggaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5473 - RNA, 696 nt, Artificial Sequence
  derived and/or modified CDS sequence (opt4) from OROV(BeAn 208823)__AY993912.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccugguggaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagagauggaugagagaggagaucguggccgugagagccgccuucgaggccgugggcacccuggccugggccagaaccggcuucagccccgccgccagagacuuccugagacaguucggcaucggcaucuga

SEQ ID NO: 5474 - RNA, 696 nt, Artificial Sequence
  derived and/or modified CDS sequence (opt4) from OROV(H244576)__HQ830444.1__N
augagcgaguucuucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugaccuuccacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagaaguacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5475 - RNA, 696 nt, Artificial Sequence
  derived and/or modified CDS sequence (opt4) from OROV(H355186)__HQ830446.1__N
augagcgaguucaucuucagcgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5476 - RNA, 696 nt, Artificial Sequence
  derived and/or modified CDS sequence (opt4) from OROV(H356898)__HQ830447.1__N
augagcgaguucaucuucaacgacgugccccagagaaccaccagcaccuucgaccccgaggccgccuacgugagcuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5477 - RNA, 696 nt, Artificial Sequence
  derived and/or modified CDS sequence (opt4) from OROV(H389865)__HQ830453.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccacaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaguuccugagacagagauacggccagaagaccgccgagcaguggaugagagaggagauccuggccgugaaggccgccuucgagagcgugggcacccuggccugggccagaaccggcuucagccccgccgccagagacuuccugagacaguucgccaucggcaucuga

SEQ ID NO: 5478 - RNA, 696 nt, Artificial Sequence
  derived and/or modified CDS sequence (opt4) from OROV(H472433)__HQ830455.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucagcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5479 - RNA, 696 nt, Artificial Sequence
  derived and/or modified CDS sequence (opt4) from OROV(H532490)__HQ830463.1__N
augagcgaguucaucuucaacgacgugccccagagaaccaccagcaccuucgaccccgaggccgccuacgugagcuucgaggccagauacggccaggugcugaacgccggcguggugagaguguucuuccugaaccagaagaaggccaaggacgugcugagaaagaccagcagccccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5480 - RNA, 696 nt, Artificial Sequence
  derived and/or modified CDS sequence (opt4) from OROV(H543629)__HQ830467.1__N
augagcgaguuccuguucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccggcagagacuuccugagacaguucggcaucggcaucuga

SEQ ID NO: 5481 - RNA, 696 nt, Artificial Sequence
  derived and/or modified CDS sequence (opt4) from OROV(H543638)__HQ830468.1__N
augagcgaguuccuguucaacgacgugccccagagaaccaccagcaccuucgaccccgaggccgccuacguggccuucgaggccagauacggccaggugcugaacgccggcguggugagaguguucuuccugaaccagaagaaggccaagaacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccggcagagacuuccugagacaguucggcaucggcaucuga

SEQ ID NO: 5482 - RNA, 696 nt, Artificial Sequence
  derived and/or modified CDS sequence (opt4) from OROV(H706890)__HQ830473.1__N
auggccgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5483 - RNA, 696 nt, Artificial Sequence
  derived and/or modified CDS sequence (opt4) from OROV(H758669)__HQ830479.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauccugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5484 - RNA, 696 nt, Artificial Sequence
  derived and/or modified CDS sequence (opt4) from OROV(H758687)__HQ830478.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuuccccuucgugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5485 - RNA, 696 nt, Artificial Sequence
  derived and/or modified CDS sequence (opt4) from OROV(H759041)__HQ830488.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaacgacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5486 - RNA, 696 nt, Artificial Sequence
  derived and/or modified CDS sequence (opt4) from OROV(BeAr473358)__AF164539.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccacaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaagauccugagacagagauacggccagaagaccgccgagcaguggaugagagaggagaucaucgccgugaagaccgccuucgagaccgugggcacccuggccugggccaucaccggcuucagccccgccgccagaaacuuccugagacaguucgagaucgacaucuga

SEQ ID NO: 5487 - RNA, 696 nt, Artificial Sequence
  derived and/or modified CDS sequence (opt4) from OROV(BeH 521086)__AY704559.1__N
augagcgaguuccuguucaacgacgugccccagagaaccaccagcaccuucgaccccgaggccgccuacguggccuucgagagcagauacggccaggugcugaacgccggcguggugagaguguucuuccugaaccagaagaaggccaaggacgugcugagaaagaccagcagacccaugguggaccugaccuucggcggcgugcaguucaccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacagagcggcaucggcaucuga

SEQ ID NO: 5488 - RNA, 696 nt, Artificial Sequence
  derived and/or modified CDS sequence (opt4) from OROV(BeH121923)__HM470110.1__N
augagcgaguucaucuucaacgacgugccccagagaaccaccagcagcuucgaccccgaggccgccuacguggccuucgaggccagauacggccaggugcugaacgccugcguggugagaguguucuuccugaaccagaagaaggccaaggacgugcugagaaagaccagcuggcccaugguggaccugaccuucggcagagugcaguucgccauggugaacaaccacuucccccaguuccagagcaaccccgugcccgacaacggccuggcccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5489 - RNA, 696 nt, Artificial Sequence
  derived and/or modified CDS sequence (opt4) from OROV(BeH379693)__AF164534.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaagaaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5490 - RNA, 696 nt, Artificial Sequence
  derived and/or modified CDS sequence (opt4) from OROV(BeH381114)__AF164535.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucugcaucuga

SEQ ID NO: 5491 - RNA, 696 nt, Artificial Sequence
  derived and/or modified CDS sequence (opt4) from OROV(BeH390233)__AF164536.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugggccaguucggcaucggcaucuga

SEQ ID NO: 5492 - RNA, 696 nt, Artificial Sequence
  derived and/or modified CDS sequence (opt4) from OROV(BeH472204)__AF164538.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacgugcagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5493 - RNA, 696 nt, Artificial Sequence
  derived and/or modified CDS sequence (opt4) from OROV(BeH505442)__AF164542.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcaggccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5494 - RNA, 696 nt, Artificial Sequence
  derived and/or modified CDS sequence (opt4) from OROV(BeH541863)__AF164544.1__N
augagcgaguucaucuucagcgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagaaacuuccugagacaguucggcaucggcaucuga

SEQ ID NO: 5495 - RNA, 696 nt, Artificial Sequence
  derived and/or modified CDS sequence (opt4) from OROV(BeH543033)__AF164545.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagaguuccugagacaguucggcaucggcaucuga

SEQ ID NO: 5496 - RNA, 696 nt, Artificial Sequence
  derived and/or modified CDS sequence (opt4) from OROV(BeH543618)__AF164548.1__N
augcaggaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5497 - RNA, 696 nt, Artificial Sequence
  derived and/or modified CDS sequence (opt4) from OROV(BeH544552)__AF164546.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacagaucggcaucggcaucuga

SEQ ID NO: 5498 - RNA, 696 nt, Artificial Sequence
  derived and/or modified CDS sequence (opt4) from OROV(GML444911)__AF164556.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucuacaucuga

SEQ ID NO: 5499 - RNA, 696 nt, Artificial Sequence
  derived and/or modified CDS sequence (opt4) from OROV(IQT4083)__AF164552.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggcaagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5500 - RNA, 696 nt, Artificial Sequence
  derived and/or modified CDS sequence (opt4) from OROV(PPS 522 H 669314)__EF467370.1__N
augagcgaguucaucagcaacgacgugccccacagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucugcaucuga

SEQ ID NO: 5501 - RNA, 696 nt, Artificial Sequence
  derived and/or modified CDS sequence (opt4) from OROV(TVP-19254/GML-480914)__KP795083.1__N
augagcgaguucaucuucaacgacgugccccagagaaccaccagcaccuucgaccccgaggccgccuacguggccuucgaggccagauacggccaggugcugagcgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5502 - RNA, 696 nt, Artificial Sequence
  derived and/or modified CDS sequence (opt4) from OROV(TVP-19256/IQE-7894)__KP795086.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucaccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5503 - RNA, 696 nt, Artificial Sequence
  derived and/or modified CDS sequence (opt4) from OROV(TVP-19258/IQT-4083)__KP795092.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagaggcaccgugguggugccccuggccgaggugaagggcugcaccuggaacgacggcgacgccauguaccugggcuucgccgccggcgccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucgacaucuga

SEQ ID NO: 5504 - RNA, 699 nt, Artificial Sequence
  derived and/or modified CDS sequence (opt4) from OROV/FPV(Aus Ch 16129)__AF362400.1__N
augaccgacuucguguucaacgacgugccccagagagccaccagcaccuucgaccccgaggccgccuacguggccuucgagaacagauucagagccaaccugaccguggacguggccagaaucuucuuccugaaccagaagaaggccaaggacagacuggccaagaccgccagagccaccguggacaucaccuucggcggcgugguguuccccguggugaacaaccacuaccccgaguaccagagaaaccccgugcccgacgacggccugacccugcacagacugagcggcuaccuggccagauggcugaucgaccagugcaacgccagccccgugagaaugaccgagaucagaaccaaggugaucaucccccuggccgaggugaagggcugcaccuggaacgacggcgccagcauguaccugggcuucgccgccggcgccgagauguuccugcagagcuucaccuucuacccccuggugaucgagaugcagagagugcugaaggacggcauggacgugaacuucaugagaaaggugcugagacagagauacggcaccaagaccgccgagcaguggaugagagacgacaucguggccgugaagaccgccuucgaggccaucaacaccaucagcugggccagaagcggcuucagccccgccgccagagaguuccugagacaguucggcaucaacaucuga

SEQ ID NO: 5505 - RNA, 696 nt, Artificial Sequence
  derived and/or modified CDS sequence (opt4) from OROV/IQTV(IQE3728/PER/06)__KF150535.1__N
augagcgaguucaucuucaacgacgugccccagagaaccaccagcaccuucgaccccgaggccgccuacguggccuucgaggccagauacggccaggugcugaacgccggcguggugagaguguucuuccugaaccagaagaaggccaaggacgugcugagaaagaccagcagacccaugguggaccugaccuucggcggcgugcaguucgccauggugaacaaccacuucccccaguuccagagcaaccccgugcccgacaacggccugacccugcacagacugagcggcuaccuggccagaugggccuucacccagaugagaagccccaucaagcaggccgaguucagagccaccgugguggugccccuggccgaggugaagggcugcaccuggaacgacggcgacgccauguaccugggcuucgccgccggcaccgagauguuccugcagaccuucaccuucuucccccuggugaucgagaugcacagagugcugaaggacggcauggacgugaacuucaugaagaaggugcugagacagagauacggccagaagaccgccgagcaguggaugagagaggagaucguggccgugagagccgccuucgaggccgugggcacccuggccugggccagaaccggcuucagccccgccgccagagacuuccugagacaguucggcaucggcaucuga

SEQ ID NO: 5506 - RNA, 699 nt, Artificial Sequence
  derived and/or modified CDS sequence (opt4) from OROV/UTIV(Be An 84785)__KF697156.1__N
auggccgaguucguguucaacgacgugccccagagaagcaccagcaccuucgaccccgagguggccuacgccaccuucgaggccgccuucagacagacccugaacgugaacguggugagaguguucuuccugaaccagaagaacgccaagaacgugcugagaaagaccagcagacccaacguggaccugaccuucggcggcgccaccuuccccaucgugaacaaccacuucccccaguuccagagcaaccccgugcccgacaacggccugacccugcacagacugagcggcuaccuggccagauggagcauggaccagaugagaaccaaccccaucagacaggccgaguucagagccgccgugguggugccccuggccgagaucaagggcugcaccuggaacgacggcgacgccauguaccuggccuucgccgccggcgccgagauguuccugaacaccuucaccuucuucccccuggugaucgagaugcacagagugcugaaggacggcauggacgugaacuucaugagaaaggugcugagacagagauacggcaccaagaccgccgagcaguggaugaaggacgagaucauccccaucaaggccgccuucgaggccgugggcaugcugagcugggccagaaccggcuucagccccgccgccagagacuuccugagacaguucggcaucaacguguga

SEQ ID NO: 5507 - RNA, 738 nt, Artificial Sequence
  derived and/or modified CDS sequence (opt4) from HRTV(TN)__KJ740146.1__N
augaccgacuggagcgccaucgccguggagaucggcaacgagccccuggacgugcccgcccugguggaguucgccaaggagaucgccuacgagggccuggaccccgccgugauccugggccugcugagagagagaggcggcgagaacuggagaaacgacgugaaguacaucaucguguucgcccugaccagaggcaacaagaucgugaaggccugcggcaagaugagcaagaagggcgccgagagaaugaccaaccuggccagaguguacgagcugaaggagaacgccguggacagaauggccgugacccccgugagaguggcccagugccugcccaccuggaccugcgccgccgccgccgccaucaaggaguaccugcccgugggccccgccaucaugcacaacaagauccagggcuacccccuggagaugaugugcauggccuucggcagccugaucccccaggccgacgugagcaucgaggugaucaaggacuucauggacgccuacagccuguggcaggacaccuucgccagaaccaucaacguggaccagagaaagaugaccaaggccgagguguacgccaaguucagagacccccugcacgccgccgugaacagccuguucuuccccaacgccaccagaaucagcuggcugcaggccaagggccugcugaccgccaccaaggaggccagcggcagcgugaaggccgccgccgccgccuacagaaacauguga

SEQ ID NO: 5508 - RNA, 738 nt, Artificial Sequence
  derived and/or modified CDS sequence (opt4) from HRTV(Patient1)__JX005842.1__N
augaccgacuggagcgccaucgccguggagaucggcaacgagccccuggacgugcccgcccugguggaguucgccaaggagaucgccuacgagggccuggaccccgccgugaucuucggccugcugagagagagaggcggcgagaacuggagaaacgacgugaaguacaucaucguguucgcccugaccagaggcaacaagaucgugaaggccugcggcaagaugagcaagaagggcgccgagagaaugaccaaccuggccagaguguacgagcugaaggagaacgccguggacagaauggccgugacccccgugagaguggcccagugccugcccaccuggaccugcgccgccgccgccgccaucaaggaguaccugcccgugggccccgccaucaugcacaacaagauccagggcuacccccuggagaugaugugcauggccuucggcagccugaucccccaggccgacgugagcaucgaggugaucaaggacuucauggacgccuacagccuguggcaggacaccuucgccagaaccaucaacguggaccagagaaagaugaccaaggccgagguguacgccaaguucagagacccccugcacgccgccgugaacagccuguucuuccccaacgccaccagaaucagcuggcugcaggccaagggccugcugaccgccaccaaggaggccagcggcagcgugaaggccgccgccgccgccuacagaaacauguga

SEQ ID NO: 5509 - RNA, 738 nt, Artificial Sequence; identical to SEQ ID NO: 5507
  derived and/or modified CDS sequence (opt4) from HRTV(Patient2)__JX005843.1__N

SEQ ID NO: 5510 - RNA, 732 nt, Artificial Sequence
  derived and/or modified CDS sequence (opt4) from PTV(PAN472868)__NC_027202.1__N
augagcuacgaggagaucgccgugcaguucgccagcgagagcaucgacgagcaggccguggccggcugggugaccgacuucgccuaccagggcuucgacgccaagagagugaucgcccuggugaaggacagaggcggcgaggacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacgccaucagcagcagcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5511 - RNA, 732 nt, Artificial Sequence
  derived and/or modified CDS sequence (opt4) from PTV(Adames)__KR912210.1__N
augagcuacgaggagaucgccgugcaguucgccagcgagagcaucgacgagcaggccguggccggcugggugaccgacuucgccuaccagggcuucgacgccaagagagugaucgcccuggugaaggagagaggcggcgaggacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacaccaucagcagcggcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5512 - RNA, 732 nt, Artificial Sequence
  derived and/or modified CDS sequence (opt4) from PTV(Balliet)__KR912211.1__N
augagcuacgaggagaucgccgugcaguucgccagcgagagcaucgacgagcagaccguggccggcugggugaccgacuucgccuaccagggcuucgacgccaagagagugaucgcccuggugaaggacagaggcggcgaggacuggaagcaggacgugaagaagaugaucgugcugagccugaccagaggcaacaagcccaacaagaugauccugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacgccaucagcagcagcuaccccagagccaugaugcaccccagcuucgccggccugaucgaccaggagcugcccgccgacguguucagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5513 - RNA, 732 nt, Artificial Sequence
  derived and/or modified CDS sequence (opt4) from PTV(PaAR2381)__KP272006.1__N
augagcuacgaggagaucgccgugcaguucgccagcgagagcaucgacgagcaggccguggccggcugggugaccgacuucgccuaccagggcuucgacgccaagagagugaucgcccuggugaaggacagaggcggcgacgacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacgccaucagcagcagcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5514 - RNA, 732 nt, Artificial Sequence
  derived and/or modified CDS sequence (opt4) from PTV(GML902876)__KP272012.1__N
augagcuacgaggagaucgccgugcaguucgccagcgagagcaucgacgagcaggccguggccggcugggugaccgacuucgccuaccagggcuucgacgccaagagagugaucgcccuggugaaggacagaggcggcgacgacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacgccaucagcagcagcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgccagcgccgccaagguguucagaagccuguga

SEQ ID NO: 5515 - RNA, 732 nt, Artificial Sequence
  derived and/or modified CDS sequence (opt4) from PTV(Adames)__KP272030.1__N
augagcuacgaggagaucgccgugcaguucgccagcgagagcaucgacgagcaggccguggccggcugggugacccacuucgccuaccagggcuucgacgccaagagagugaucgcccuggugaaggagagaggcggcgaggacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacaccaucagcagcggcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugagcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5516 - RNA, 735 nt, Artificial Sequence
  derived and/or modified CDS sequence (opt4) from Phlebovirus(CoAr171616)__HM566153.1__N
augagcuacgaggagaucgccgugaacuucgccagcgagagcaucgacgagagcaccaucagcgccugggugagcgacuucgccuaccagggcuucgacgccaagagagugaucgcccugaucaaggagagaggcggcgagaacuggaaggaggacgugaagaagaugaucgugcugagccugaccagaggcaacaagcccgccaagaugauccugaagaugagcgacaagggcaagaaggaggugaacgaccugaucaccagauacaagcugaagagcggcaaccccagcagagacgaccugacccugagcagaguggccgccgccuucgccggcuggaccugccaggccgccgaguacgugcaggaguaccugcccgugaccggcagagccauggacgccuucagcgccgacuuccccagagcccugaugcaccccagcuucgccggccugaucgaccaggagcugcccagcagcgccaugaccgacaucgugcacgcccacugccuguucaugauccaguucagcaagaccaucaaccccaccaucagaagcgccagcaaggacgagaucguggccagcuucgacagacccaugcaggccgccaucaacagcaccuuccugaccagcgcccagagaagagccaugcugaagacccugggcgugaucaacgacaaccugaaggugagcaccgccgugagcagcgccgccaaggccuucaagaagcugcaguga

SEQ ID NO: 5517 - RNA, 735 nt, Artificial Sequence
  derived and/or modified CDS sequence (opt4) from Phlebovirus(CoAr171616)__EF201836.1__N
augagcuacgaggagaucgccauccacuucgccagcgagagcaucgacgagagcaccaucagcgccugggugagcgacuucgccuaccagggcuucgacgccaagagagugaucgcccugaucaaggagagaggcggcgagaacuggaaggaggacgugaagaagaugaucgugcugagccugaccagaggcaacaagcccgccaagaugauccugaagaugagcgacaagggcaagaaggaggugaacgaccugaucaccagauacaagcugaagagcggcaaccccagcagagacgaccugacccugagcagaguggccgccgccuucgccggcuggaccugccaggccgccgaguacgugcaggaguaccugcccgugaccggcagagccauggacgccuucagcgccgacuuccccagagcccugaugcaccccagcuucgccggccugaucgaccaggagcugcccagcagcgccaugaccgacaucgugcacgcccacugccuguucaugauccaguucagcaagaccaucaaccccaccaucagaagcgccagcaaggacgagaucguggccagcuucgacagacccaugcaggccgccaucaacagcaccuuccugaccagcgcccagagaagagccaugcugaagacccugggcgugaucaacgacaaccugaaggugagcaccgccgugagcagcgccgccaaggccuucaagaagcugcaguga

SEQ ID NO: 5518 - RNA, 732 nt, Artificial Sequence
  derived and/or modified CDS sequence (opt4) from Phlebovirus(CoAr170255)__EF201840.1__N
augagcuacgaggagaucgccauccaguucgccagcgagagcguggacgccaccaccaucgccgccugggugagcgaguucgccuaccagggcuucgacgccagacaggugaucaaccuggugaagcagagaggcggcgacgacuggaaggaggacgugaagaagaugaucgugcugagccugaccagaggcaacaagcccagcaagaugcugaacaagaugagcgagagcggccagaagaucgugaacgaccugaucagcaaguacaagcugaagagcggcaaccccggcagaaacgaccugacccugagcagaaucgccgccgccuucgccggcuggaccugccaggccgccgagguggugcaggacuaccugcccgugaccggcagagccauggacgccaucagcgacaaguuccccagagcccugaugcaccccagcuucgccggccugguggaccccacccugcccgagggcgugguggaggacaucgugcacgcccacugccuguucaugauccaguucagcaagaccaucaaccccagccugagaagcagcagcaagagcgagguggugagcagcuucgacagacccaugcaggccgccaucaacagccccuuccugaccgccggcaacagaagagacauccugaugagccugggccugaucaacagcaaccugaagcccagccccgccgugaucgccgccgccaagguguacagaaagcuguga

SEQ ID NO: 5519 - RNA, 732 nt, Artificial Sequence
  derived and/or modified CDS sequence (opt4) from Buenaventura virus(CoAr3319)__KP272003.1__N
augagcuacgaggagaucgccauccaguucgccagcgagagcguggacgccaccaccaucgccgccugggugagcgaguucgccuaccagggcuucgacgccagacaggugaucaaccuggugaagcagagaggcggcgacgacuggaaggaggacgugaagaagaugaucgugcugagccugaccagaggcaacaagcccagcaagaugcugaacaagaugagcgagagcggccagaagaucgugaacgaccugaucagcaaguacaagcugaagagcggcaaccccggcagaaacgaccugacccugagcagaaucgccgccgccuucgccggcuggaccugccaggccgccgagguggugcaggacuaccugcccgugaccggcagagccauggacgccaucagcgacaaguuccccagagcccugaugcaccccagcuucgccggccugguggaccccacccugcccgagggcgugguggaggacaucgugcacgcccacugccuguucaugauccaguucagcaagaccaucaaccccagccugagaagcagcagcaagagcgagguggugagcagcuucgacagacccaugcaggccgccaucaacagccccuuccugaccgccggcaacagaagagacauccugaugagccugggccugaucaacagcaaccugaagcccagccccaccgugguggccgccgccaagguguacagaaagcuguga

SEQ ID NO: 5520 - RNA, 732 nt, Artificial Sequence
  derived and/or modified CDS sequence (opt4) from Cocle virus(GML244915)__KP272035.1__N
augagcuacgaggagaucgccgugcaguucgccagcgagagcaucgacgagcaggccguggccggcugggugaccgacuucgccuaccagggcuucgacgccagaagagugaucgcccuggugaaggacagaggcggcgaggacuggaagcaggacgugaagaagaugaucgugcugagccugaccagaggcaacaagcccaacaagauggugcugaagaugagcgacaagggcaaggccauggugaacgagcuggugcugaaguacaagcugaagagcggcaaccccagcagagacgaccugacccugagcagaaucaccgccgccuucgccggcuggaccugccaggccgccgacuacgugcaggaguaccugcccgugaccggcagagccauggacgccaucagcagcggcuaccccagagccaugaugcaccccagcuucgccggccugaucgaccaggagcugcccgccgacgugcugagcgagaucacccaggcccacugccuguucaugauccaguucagcaagaccaucaaccccagccugagaggccugggcaaggacgagaucgugagcagcuucgagagacccaugcaggccgccaucagcagcaccuuccugaccagcgccaacagaagagccaugcugaagacccugggcaucaucaacgacaaccugaagcccagcagcagcaccgugagcgccgccaagguguucagaagccuguga

SEQ ID NO: 5521 - RNA, 732 nt, Artificial Sequence
  derived and/or modified CDS sequence (opt4) from Capira virus(VP-366G)__KP272044.1__N
augagcuacgaggagaucgccauccaguucgccagcgagagcaucgacgagagcaccaucgccgccugggugagcgacuucgccuaccagggcuucgacgccaagcaggugaucauccugaucaagaagagaggcggcgagaacuggaaggaggacgugaagaagaugaucgugcugagccugaccagaggcaacaagcccagcaagauggugaacaagaugagcgacgagggcaagaagguggugaacgagcugaucagcaaguacaagcugaagaccggcaaccccgccagagacgaccugacccugagcagaaucgccgccgccuucgccggcuggaccugccaggccgccgaguacgugcaggacuaccugcccgugaccggcagagccauggacgcccugagcgacaaguaccccagagcccugaugcaccccagcuucgccggccugaucgaccccacccugcccgacgacgccgugaaggacaucgugcacgcccacugccuguucaugauccaguucagcaagaccaucaaccccagccugagaagcagcaccaagaccgagaucgugaacagcuucgacagacccaugcaggccgccaucaacagccccuuccugaccgccgagaacagaagagccaugcugaccacccugggcgugaucaacagcaaccugaagcccagcgccgccgugguggccgccgccaaggccuacagaaagcuguga

SEQ ID NO: 5522 - RNA, 732 nt, Artificial Sequence
  derived and/or modified CDS sequence (opt4) from Campana virus(VP-334K)__KP272042.1__N
augagcuacgaggagaucgccauccaguucgccagcgagagcguggacgccaccaccaucgccgccugggugagcgaguucgccuaccagggcuucgacgccagacaggugaucaaccuggugaagcagagaggcggcgacgacuggaaggaggacgugaagaagaugaucgugcugagccugaccagaggcaacaagcccagcagaauggugaccaagaugagcgagagcggccagaagaucgugaacgaccugaucagcaaguacaagcugaagagcggcaaccccggcagaaacgaccugacccugagcagaguggccgccgccuucgccggcuggaccugccaggccgccgagguggugcaggacuaccugcccgugaccggcagagccauggacgcccugagcgacaaguuccccagagccaucaugcaccccagcuucgccggccugaucgaccccacccugcccgagaacgugguggaggacaucgugcacgcccacugccuguucaugauccaguucagcaagaccaucaaccccagccugagaagcagcagcaagagcgagguggugagcagcuucgacagacccaugcaggccgccaucaacagccccuuccugaccgccgccaacagaagagacaugcugaugagccugggccugaucagcagcaaccugaagcccagcgccgccgugaccgccgccgccaaggccuacagaaagcuguga

SEQ ID NO: 5523 - RNA, 738 nt, Artificial Sequence
  derived and/or modified CDS sequence (opt4) from RVFV(ZH-548)__DQ380151.1__N
auggacaacuaccaggagcuggccauccaguucgccgcccaggccguggacagaaacgagaucgagcagugggugagagaguucgccuaccagggcuucgacgccagaagagugaucgagcugcugaagcaguacggcggcgccgacugggagaaggacgccaagaagaugaucgugcuggcccugaccagaggcaacaagcccagaagaaugaugaugaagaugagcaaggagggcaaggccaccguggaggcccugaucaacaaguacaagcugaaggagggcaaccccagcagagacgagcugacccugagcagaguggccgccgcccuggccggcuggaccugccaggcccugguggugcugagcgaguggcugcccgugaccggcaccaccauggacggccugagccccgccuaccccagacacaugaugcaccccagcuucgccggcaugguggaccccagccugcccggcgacuaccugagagccauccuggacgcccacagccuguaccugcugcaguucagcagagugaucaaccccaaccugagaggcagaaccaaggaggagguggccgccaccuucacccagcccaugaacgccgccgugaacagcaacuucaucagccacgagaagagaagagaguuccugaaggccuucggccugguggacagcaacggcaagcccagcgccgccgugauggccgccgcccaggccuacaagaccgccgccuga

SEQ ID NO: 5524 - RNA, 738 nt, Artificial Sequence
  derived and/or modified CDS sequence (opt4) from RVFV(OV 35/74)__EF530207.1__N
auggacaacuaccaggagcuggccauccaguucgccgcccaggccguggacagaaacgagaucgagcagugggugagagaguucgccuaccagggcuucgacgccagaagagugaucgagcugcugaagcaguacggcggcgccgacugggagaaggacgccaagaagaugaucgugcuggcccugaccagaggcaacaagcccagaagaaugaugaugaagaugagcaaggagggcaaggccaccguggaggcccugaucaacaaguacaagcugaaggagggcaaccccagcagagacgagcugacccugagcagaguggccgccgcccuggccggcuggaccugccaggcccugguggugcugagcgaguggcugcccgugaccggcaccaccauggacggccugagccccgccuaccccagacacaugaugcaccccagcuucgccggcaugguggaccccagccugcccgaggacuaccugagagccauccuggacgcccacagccuguaccugcugcaguucagcagagugaucaaccccaaccugagaggcagaaccaaggaggagguggccgccaccuucacccagcccaugaacgccgccgugaacagcaacuucaucagccacgagaagagaagagaguuccugaaggccuucggccugguggacagcaacggcaagcccagcgccgccgugauggccgccgcccaggccuacaagaccgccgccuga

SEQ ID NO: 5525 - RNA, 762 nt, Artificial Sequence
  derived and/or modified CDS sequence (opt4) from SFNV(Toscana)__NC_006318.1__N
augagcgacgagaacuacagagacaucgcccuggccuuccuggacgagagcgccgacagcggcaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccagcaucguggccaaccugaucagcguguaccagcugaaggagggcaaccccggcagagacaccaucacccugagcagagugagcgccgccuucgugcccuggaccgugcaggcccugagagugcugagcgagagccugcccgugagcggcaccaccauggacgccaucgccggcgugaccuaccccagagccaugaugcaccccagcuucgccggcaucaucgaccuggaccugcccaacggcgccggcgccaccaucgccgacgcccacggccuguucaugaucgaguucagcaagaccaucaaccccagccugagaaccaagcaggccaacgagguggccgccaccuucgagaagcccaacauggccgccaugagcggcagauucuucaccagagaggacaagaagaagcugcugaucgccgugggcaucaucgacgaggaccuggugcuggccagcgccguggugagaagcgccgagaaguacagagccaaggugggcaaguga

SEQ ID NO: 5526 - RNA, 762 nt, Artificial Sequence
  derived and/or modified CDS sequence (opt4) from SFNV__HM566170.1__N
augagcgaggagaacuacagagagaucgcccuggccuuccuggacgaggccgccgacagcggcaccaucaccgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccggcaucguggcccagcugaucagcguguaccagcugaaggagggcaaccccggcagagacaccaucacccugagcagagugagcgccgccuucgugcccuggaccauccaggcccugagagugcugagcgacagccugcccgugaccggcaccaccauggacgccaucgccggcgugaccuaccccagagccaugaugcaccccagcuucgccggcaucaucgaccuggaccugcccaacagagccggcgaggugaucgccgacgcccacggccuguucaugcuggaguucagcaagaccaucaaccccagccugagaaccaagcagcccaacgagaucgccgccaccuucgagaagcccaacauggccgccaugagcggcagauucuucaccagagaggacaagaagaagcugcugauggccgugggcauccugaacgaggaccuggugcugacccccgccaucgugaagugcgccgagaaguacugcagcaaggugggcaaguga

SEQ ID NO: 5527 - RNA, 735 nt, Artificial Sequence; identical to SEQ ID NO: 5516
  derived and/or modified CDS sequence (opt4) from SFNV(Namru)__HM566168.1__N

SEQ ID NO: 5528 - RNA, 762 nt, Artificial Sequence
  derived and/or modified CDS sequence (opt4) from SFNV(NAMRU 840055)__EF201828.1__N
augagcgaggagaacuacagagagaucgcccuggccuuccuggacgaggccgccgacagcggcaccaucaccgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccggcaucguggcccagcugaucagcguguaccagcugagagagggcaaccccggcagagacaccaucacccugagcagagugagcgccgccuucgugcccuggaccauccaggcccugaaggugcugagcgacagccugcccgugaccggcaccaccauggacgccaucgccggcgugguguaccccagagccaugaugcaccccagcuucgccggcaucaucgaccuggaccugcccaacagagccggcgaggccaucgccgacgcccacggccuguucaugcuggaguucagcaagaccaucaaccccagccugagaaccaagcagcccaacgagaucgccgccaccuucgagaagcccaacauggccgccaugagcggcagauucuucaccagagaggacaagaagaagcugcugauggccgugggcauccugaacgaggaccuggugcugacccccgccaucgugaagugcgccgagaaguacagaagcaaggugggcaaguga

SEQ ID NO: 5529 - RNA, 762 nt, Artificial Sequence
  derived and/or modified CDS sequence (opt4) from SFNV(NAMRU 840055)__EF201829.1__N
augagcgaggagaacuacagagagaucgcccuggccuuccuggacgaggccgccgacagcggcaccaucaccgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccggcaucguggcccagcugaucagcguguaccagcugaaggagggcaaccccggcagagacaccaucacccugagcagagugagcgccgccuucgugcccuggaccauccaggcccugagagugcugagcgacagccugcccgugaccggcaccaccauggacgccaucgccggcgugaccuaccccagagccaugaugcaccccagcuucgccggcaucaucgaccuggaccugcccaacagagccggcgaggccaucgccgacgcccacggccuguucaugcuggaguucagcaagaccaucaaccccagccugagaaccaagcagcccaacgagaucgccgccaccuucgagaagcccaacauggccgccaugagcggcagauucuucaccagagaggacaagaagaagcugcugauggccgugggcauccugaacgaggaccuggugcugacccccgccaucgugaagugcgccgagaaguacugcagcaaggugggcaaguga

SEQ ID NO: 5530 - RNA, 762 nt, Artificial Sequence
  derived and/or modified CDS sequence (opt4) from SFNV(P-7101795)__EF201830.1__N
augagcgaggagaacuacagagagaucgcccuggccuuccugaacgaggccgccgacagcggcaccaucaccgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgagaccaugaugaagaagaugagcgagaagggcgccggcaucguggcccagcugaucagcguguaccagcugaaggagggcaaccccggcagagacaccaucacccugagcagagugagcgccgccuucgugcccuggaccgugcaggcccugagagugcugagcgacagccugcccgugaccggcaccaccauggacgccaucgccggcgugaccuaccccagagccaugaugcaccccagcuucgccggcaucaucgaccuggaccugcccaacagagccggcgagaccaucgccgacgcccacggccuguucaugcuggaguucagcaagaccaucaaccccagccugagaaccaagcagcccaacgagaucgccgccaccuucgagaagcccaacauggccgccaugagcggcagauucuucaccagagaggacaagaagaagcugcugauggccgugggcgugcugaacgaggaccuggugcugacccccgccaucgugaagugcgccgagaaguacagaagcaaggugggcaaguga

SEQ ID NO: 5531 - RNA, 762 nt, Artificial Sequence
  derived and/or modified CDS sequence (opt4) from SFNV(P-7101795)__EF201832.1__N
augagcgaggagaacuacagagagaucgcccuggccuuccuggacgaggccgccgacagcggcaccaucaccgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccggcaucguggcccagcugaucagcguguaccagcugagagagggcaaccccggcagagacaccaucacccugagcagagugagcgccgccuucgugcccuggaccauccaggcccugaaggugcugagcgacagccugcccgugaccggcaccaccauggacgccaucgccggcgugauguaccccagagccaugaugcaccccagcuucgccggcaucaucgaccuggaccugcccaacagagccggcgaggccaucgccgacgcccacggccuguucaugcuggaguucagcaagaccaucaaccccagccugagaaccaagcagcccaacgagaucgccgccaccuucgagaagcccaacauggccgccaugagcggcagauucuucaccagagaggacaagaagaagcugcugauggccgugggcauccugaacgaggaccuggugcugacccccgccaucaucaagugcgccgagaaguacagaagcaaggugggcaaguga

SEQ ID NO: 5532 - RNA, 762 nt, Artificial Sequence
  derived and/or modified CDS sequence (opt4) from Arrabida virus(PoSFPhlebV/126/2008)__KP863801.1__N
augagcgaggacaacuacagaaccaucgcccuggccuuccuggacgagagcgccgacagcaccaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgagagcaugaugaagaagaugagcgagaagggcgccgccaucgugacccagcugaucagcaccuaccagcugaaggagggcaaccccggcagagacaccaucacccugagcagagugagcgccgccuucgugcccuggaccgugcaggcccugaagacccugagcgagagccugcccgugaccggcaccaccauggacagcaucgccggcaccaccuaccccagaugcaugaugcaccccagcuucgccggcaucaucgaccuggagcugcccaacaacaccggcgccaugcuggccgacgcccacggccuguucaugcuggaguucagcaagaccaucaaccccagccugagaaccaagcagcccaacgagaucgccgccaccuucgagaagcccaacauggccgccaugaccggcagauucuucaccagagacgacaagaagaagcugcugaucgccaucggcgugcuggacgaggaccuggugcccaaccccgccaucgagaagugcgccgagaaguacaaggccaaggugggcaaguga

SEQ ID NO: 5533 - RNA, 765 nt, Artificial Sequence
  derived and/or modified CDS sequence (opt4) from Gordil virus(Dak ANBr 496d)__KF297902.1__N
augagcgaggagaacuacagagagaucgccauggccuucgccaacgacagcgccgacuucaacaugaucagcgugugggccaacgacuucgccuaccagggcuucgaccccaagagaaucguggagcuggugagacagagaggccuggccaaggccagaaacuggaagcaggacgugaagaugaugaucgugcugaaccugaugagaggcaacaagcccgaggccauggugagaaagaugcaggagaagggccagagaaucgugcuggagcugaucagcguguacgagcugaaggagggcaaccccggcagagacaccaucacccugagcagagugagcgccgccuucgugcccuggaccaucauggcccugagacagcuggccgagaacauccccgugaccggcagcaucauggacagcauccuggacggcgccguguaccccagagccaugaugcaccccagcuucgccggcaucaucgaccuggagcugcccgagggcagaggcgccgagcuggccgacgcccacggccuguucaugaucgaguucagcaagaccaucaaccccagccugagaaccaagagcgccaucgagaucgccgccagcuucgagaagcccaacauggccgccaugaccggcaacuucuucaccaaggacgacaagagaaagcugcugaagcagaucggcauccuggacagcgaccugaagcugacccccgugaucgagaaggccgccgcccuguacagaagcaagaccaacaaguga

SEQ ID NO: 5534 - RNA, 762 nt, Artificial Sequence
  derived and/or modified CDS sequence (opt4) from Granada virus(GR25)__GU135608.1__N
augagcgaggacaacuacagaaccaucgcccuggccuuccuggacgagagcgccgacagcaccaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgagagcaugaugaagaagaugagcgagaagggcgccgccaucgugacccagcugaucagcaccuaccagcugaaggagggcaaccccggcagagacaccaucacccugagcagagugagcgccgccuucgugcccuggaccgugcaggcccugaagacccugagcgagagccugcccgugaccggcaccaccauggacagcaucgccggcaccaccuaccccagaugcaugaugcaccccagcuucgccggcaucaucgaccuggagcugcccaacaacaccggcgccaugcuggccgacgcccacggccuguucaugcuggaguucagcaagaccaucaaccccagccugagaaccaagcagcccaacgagaucgccgccaccuucgagaagcccaacauggccgccaugaccggcagauucuucaccagagacgacaagaagaagcugcugaucgccaucggcgugcugaacgaggaccuggugcccaaccccgccaucgagaagugcgccgagaaguacaaggccaaggugggcaaguga

SEQ ID NO: 5535 - RNA, 762 nt, Artificial Sequence
  derived and/or modified CDS sequence (opt4) from Massilia virus(127)__KT906102.1__N
augagcgaggacaacuacagaaccaucgcccugagcuuccuggacgagaccgccgugagcaccagcaucaacgccugcgugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgagagcaugaugaagaagaugagcgagaagggcgccgccaucgugacccagcugaucagcaccuaccagcugaaggagggcaaccccggcagagacaccaucacccugagcagagugagcgccgccuucgugcccuggaccgugcaggcccugaagacccugagcgagagccugcccgugaccggcaccaccauggacagcaucgccggcaccaccuaccccagaugcaugaugcaccccagcuucgccggcaucaucgaccuggagcugcccaacaacaccggcgccaugcuggccgacgcccacggccuguucaugcuggaguucagcaagaccaucaaccccagccugagaaccaagcagcccaacgagaucgccgccaccuucgagaagcccaacauggccgccaugaccggcagauucuucaccagagacgacaagaagaagcugcugaucgccaucggcgugcuggacgaggaccuggugcccaaccccgccaucgagaagugcgccgagaaguacaaggccaaggugggcaaguga

SEQ ID NO: 5536 - RNA, 762 nt, Artificial Sequence
  derived and/or modified CDS sequence (opt4) from Massilia virus(130)__KT906103.1__N
augagcgaggacaacuacagaaccaucgcccugagcuuccuggacgagaccgccgacagcaccagcaucaacgccugcgugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgagagcaugaugaagaagaugagcgagaagggcgccgccaucgugacccagcugaucagcaccuaccagcugaaggagggcaaccccggcagagacaccaucacccugagcagagugagcgccgccuucgugcccuggaccgugcaggcccugaagacccugagcgagagccugcccgugaccggcaccaccauggacagcaucgccggcaccaccuaccccagaugcaugaugcaccccagcuucgccggcaucaucgaccuggagcugcccaacaacaccggcgccaugcuggccgacgcccacggccuguucaugcuggaguucagcaagaccaucaaccccagccugagaaccaagcagcccaacgagaucgccgccaccuucgagaagcccaacauggccgccaugaccggcagauucuucaccagagacgacaagaagaagcugcugaucgccaucggcgugcuggacgaggaccuggugcccaaccccgccaucgagaagugcgccgagaaguacaaggccaaggugggcaaguga

SEQ ID NO: 5537 - RNA, 762 nt, Artificial Sequence
  derived and/or modified CDS sequence (opt4) from Naples virus(Yu 8/76)__JF920141.1__N
augagcgaggacgacuaccacaagaucgcccuggccuucgccgaggagagcgccgacgugagcaccaucgagagcugggugaacgacuucgccuaccagggcuucgaccccagaagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccgccaucguggcccagcugaucagcguguaccagcugaaggagggcaaccccggcagagacaccaucacccugagcagagugagcgccgccuucgugcccuggaccgugcaggcccugagagugcugagcgaccaccugcccgugaccggcaccaccauggacgccaucgccggcgugaccuaccccagagccaugaugcaccccagcuucgccggcaucguggaccuggagcugcccagaaagaccggcgagaugaucgccgacgcccacggccuguucaugcuggaguucagcaagaccaucaaccccagccugagaaccaagcagcccaacgagaucgccaccaccuucgagaagcccaacauggccgccaugagcggcaaguucuucagcagagaggacaagaagaagcugcugaugagcgugggcaucaucaacgacgaccugcugcugaccgccagcguggugaagugcgccgagaaguacagagccaagaccggcaaguga

SEQ ID NO: 5538 - RNA, 762 nt, Artificial Sequence
  derived and/or modified CDS sequence (opt4) from Punique virus(P1_B4_2008)__FJ848987.1__N
augagcgaggagaacuacagagagaucgcccuggccuuccuggacgagagcgccgacagcggcaccaucagcaccugggugaacgacuucgccuaccagggcuucgaccccaagagaaucgugcagcuggugaaggagagaggcaccgccaagggcagagacuggaagaaggacgugaagaugaugaucgugcugaaccuggugagaggcaacaagcccgagagcaugaugaagaagaugagcgagaagggcgccgccaucguggcccagcugaucgccgccuaccagcugaaggagggcaaccccggcagagacaccaucacccugagcagagugagcgccgccuucgugcccuggaccgugcaggcccugagaagccugagcgacagccugcccgugaccggcaccaccauggacagcaucgccggcgugaccuaccccagaugcaugaugcaccccagcuucgccggcaucaucgaccuggaccugcccaacgacaccggcgccaugcuggccgacgcccacggccuguucaugcuggaguucagcaagaccaucaaccccagccugagaaccaagcaggccaacgagaucgccgccaccuucgagaagcccaacauggccgccaugaacggcagauucuucaccagagaggacaagaagaagcugcugaucgccaucggcgugcugaacgaggaccugauccccgugagcgccaucgccaagugcgccgagaaguacagagccaaggugggcaaguga

SEQ ID NO: 5539 - RNA, 762 nt, Artificial Sequence
  derived and/or modified CDS sequence (opt4) from Saint Floris virus(Dak ANB512)__JF920138.1__N
augagcgaggagaccuacgcccagcuggccauggccuuccuggccgagcccgccgacuggagcacccugagcgugugggugaacgaguucgccuaccagggcuucgaccccaagagaaucguggagcugaucauggagagaggcaagaaguucaacagagaguggaagaaggacgugaagaugaugaucacccugaaccugaucagaggcaacaagcccgaggccaugaugagaaagaugagcgacaagggcagaagcaucgugagcgagcugaucagcguguacgagcugaaggagggcaaccccggcagagacaccaucacccugagcagagugagcgccgccuucgugcccuggaccgugagagcccugguggcccugcagaacgaccugcccgugaccggcgccgccauggacagcaucugcggcgugaccuaccccagagccaugaugcaccccagcuucgccggcgugaucgaccuggagcugcccaacggcgugggcgcccagcuggccgacgcccacggccuguucaugcuggaguucagcaagaccaucaaccccggccugagaaccaagcagcccaacgagaucgccgccaccuucgagaagcccaaccuggccgccaugaccggcaaguucuucaccaaggaggacaagagaaaggugcugaucagcgugggcgugaucaacagcgaccugcagcccaacagcguggugaagaccugcgccgagcuguacagagccagagugaugaaguga

SEQ ID NO: 5540 - RNA, 762 nt, Artificial Sequence
  derived and/or modified CDS sequence (opt4) from Tehran virus(I-47)__JF939848.1__N
augagcgaggaggacuacagagccaucgcccugagcuucagcgacgagagcgccgacgugggcaucaucaccaccugggugaacgaguucgccuaccagggcuucgaccccaagagaaucgugcagcuggugaaggagagaggccaggccaagggcagagacuggaagaaggacgugaagaugaugaucgugcugaaccugaucagaggcaacaagcccgacgccaugaugaagaagaugagcgagaagggcgccgccaccguggcccagcuggugagcguguaccagcugaaggagggcaaccccggcagagacaccaucacccugagcagagugagcgccgccuucgugcccuggaccgugcaggcccugaaggugcugagcgagagccugcccgugaccggcaccaccauggacaccguggccggcgugaccuaccccagagccaugaugcaccccagcuucgccggcaucaucgaccuggagcugcccggcagagccggcgaggccaucgccgacgcccacggccuguucaugcuggaguucagcaagaccaucaaccccagccugagaaccaagcagcccaacgagaucgccgccaccuucgagaagcccaacauggccgccaugaccggcagauucuucaccagagaggacaagaagaagcugcugaucgccgugggcaucaucaacgacgaccugcugcugacccccagcaucgccaagugcgccgagaaguacagagccaaggugggcaaguga

SEQ ID NO: 5541 - RNA, 762 nt, Artificial Sequence
  derived and/or modified CDS sequence (opt4) from Zerdali virus(37)__KP966618.1__N
augagcgaggaggacuacagagccaucgcccugagcuucagcgacgaggccgccgacgugggcaccaucaccgccugggugaacgaguucgccuaccagggcuucgaccccaagagaaucgugcagcuggugagagagagaggcaucgccaagggcagagacuggaagaaggacgugaagaugaugaucgugcugaaccugaucagaggcaacaagcccgacgccaugaugaagaagaugagcgagaagggcgccgccaccguggcccagcuggugagcguguaccagcugaaggagggcaaccccggcagagacaccaucacccccagcagagugagcgccgccuucgugcccuggaccgugcaggcccugaaggugcugagcgagagccugcccgugaccggcaccaccauggacaccaucgccggcgugagcuaccccagagccaugaugcaccccagcuucgccggcaucaucgaccuggagcugcccagaagagccggcgaggugaucgccgacgcccacggccuguucaugcuggaguucagcaagaccaucaaccccagccugagaaccaagcagcccaacgagaucgccgccaccuucgagaagcccaacauggccgccaugaccggcagauucuucaccagagaggacaagaagaagcugcugaucgccgugggcaucaucaacgacgaccugcugcuggcccccagcguggccaagugcgccgagaaguacagagccaaggugggcaaguga

SEQ ID NO: 5542 - RNA, 762 nt, Artificial Sequence; identical to SEQ ID NO: 5525
  derived and/or modified CDS sequence (opt4) from TOSV(9028)__KU904263.1__N

SEQ ID NO: 5543 - RNA, 762 nt, Artificial Sequence
  derived and/or modified CDS sequence (opt4) from TOSV(SI-121283)__JF330274.1__N
augagcgacgagaacuacagagacaucgcccuggccuuccuggacgagagcgccgacagcggcaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccagcaucguggccaaccugaucagcguguaccagcugaaggagggcaaccccggcagagacaccaucacccugagcagagugagcgccgccuucgugcccuggaccgugcaggcccugagagugcugagcgagagccugcccgugagcggcaccaccauggacgccaucgccggcgugaccuaccccagagccaugaugcaccccagcuucgccggcaucaucgaccuggaccugcccaacggcgccggcgccaccaucgccgacgcccacggccuguucaugaucgaguucagcaagaccaucaaccccagccugagaaccaagcaggccaacgagguggccgccaccuucgagaaccccaacauggccgccaugagcggcagauucuucaccagagaggacaagaagaagcugcugaucgccgugggcaucaucgacgaggaccuggugcuggccagcgccguggugagaagcgccgagaaguacagagccaaggugggcaaguga

SEQ ID NO: 5544 - RNA, 762 nt, Artificial Sequence
  derived and/or modified CDS sequence (opt4) from TOSV(5963930705)__KU935733.1__N
augagcgacgagaacuacagagacaucgcccuggccuuccuggacgagagcgccgacagcggcaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccagcaucguggccaaccugaucagcguguaccagcugaaggagggcaaccccggcagagacaccaucacccugagcagagugagcgccgccuucgugcccuggaccgugcaggcccugagagugcugagcgagagccugcccgugagcggcaccaccauggacgccaucgccggcgugaccuaccccagagccaugaugcaccccagcuucgccggcaucaucgaccuggaccugcccaacggcgccggcgccaccaucgccgacgcccacggccuguucaugguggaguucagcaagaccaucaaccccagccugagaaccaagcaggccaacgagguggccgccaccuucgagaagcccaacauggccgccaugagcggcagauucuucaccagagaggacaagaagaagcugcugaucgccgugggcaucaucgacgaggaccuggugcuggccagcgccguggugagaagcgccgagaaguacagagccaaggugggcaaguga

SEQ ID NO: 5545 - RNA, 762 nt, Artificial Sequence
  derived and/or modified CDS sequence (opt4) from TOSV(MRS2010-4319501)__KC776214.1__N
augagcgacgagaacuacagagacaucgcccuggccuuccuggacgagagcgccgacagcggcaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccagcaucguggccaaccugaucagcguguaccagcugaaggagggcaaccccggcagagacaccaucacccugagcagagugagcgccgccuucgugcccuggaccgugcaggcccugagagugcugagcgagagccugcccgugagcggcaccaccauggacgccaucgccggcgugaccuaccccagagccaugaugcaccccagcuucgccggcaucaucgaccugcaccugcccaacggcgccggcgccaccaucgccgacgcccacggccuguucaugaucgaguucagcaagaccaucaaccccagccugagaaccaagcaggccaacgagguggccgccaccuucgagaagcccaacauggccgccaugagcggcagauucuucaccagagaggacaagaagaagcugcugaucgccgugggcaucaucgacgaggaccuggugcuggccagcgccguggugagaagcgccgagaaguacagagccaaggugggcaaguga

SEQ ID NO: 5546 - RNA, 762 nt, Artificial Sequence
  derived and/or modified CDS sequence (opt4) from TOSV(TOSV/Firenze.ITA/1983/2)__KM275765.1__N
augagcgacgagaacuacagagacaucgcccuggccuuccuggacgagugcgccgacagcggcaccaucaacgccugggugaacgaguucgccuaccagggcuucgaccccaagagaaucgugcagcuggugaaggagagaggcaccgccaagggcagagacuggaagaaggacgugaagaugaugaucgugcugaaccuggugagaggcaacaagcccgaggccaugaugaagaagaugagcgagaagggcgccagcaucguggccaaccugaucagcguguaccagcugaaggagggcaaccccggcagagacaccaucacccugagcagagugagcgccgccuucgugcccuggaccgugcaggcccugagagugcugagcgagagccugcccgugagcggcaccaccauggacgccaucgccggcgugaccuaccccagagccaugaugcaccccagcuucgccggcaucaucgaccuggaccugcccaacggcgccggcgccaccaucgccgacgcccacggccuguucaugaucgaguucagcaagaccaucaaccccagccugagaaccaagcaggccaacgagguggccgccaccuucgagaagcccaacauggccgccaugagcggcagauucuucaccagagaggacaagaagaagcugcugaucgccgugggcaucaucgacgaggaccuggugcuggccagcgccguggugagaagcgccgagaaguacagagccaaggugggcaaguga

SEQ ID NO: 5547 - RNA, 738 nt, Artificial Sequence
  derived and/or modified CDS sequence (opt4) from SFTSV(HB29)__NC_018137.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5548 - RNA, 738 nt, Artificial Sequence
  derived and/or modified CDS sequence (opt4) from SFTSV(111S)__KP339904.1__N
augagcgaguggagcagaaucgccguggaguucggcgagcagcagcugaaccugaccgagcuggaggacuucgccagagagcuggccuacgagggccuggacagagcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5549 - RNA, 738 nt, Artificial Sequence
  derived and/or modified CDS sequence (opt4) from SFTSV(116S)__KP339905.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagaucuacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5550 - RNA, 738 nt, Artificial Sequence
  derived and/or modified CDS sequence (opt4) from SFTSV(132S)__KP339912.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucagcguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5551 - RNA, 738 nt, Artificial Sequence
  derived and/or modified CDS sequence (opt4) from SFTSV(2014045S)__KR075923.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgcccccagcagagccgccgagguggccgccgccgccuacagaaaccuguga

SEQ ID NO: 5552 - RNA, 738 nt, Artificial Sequence
  derived and/or modified CDS sequence (opt4) from SFTSV(2014193S)__KR075916.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcgugacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5553 - RNA, 738 nt, Artificial Sequence
  derived and/or modified CDS sequence (opt4) from SFTSV(2015SH232S)__KT736097.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugagauggcugaaggccaagggcauccugggccccgacggcgugcccagcagagccgccgagguggccgccgccgccuacagaaaccuguga

SEQ ID NO: 5554 - RNA, 738 nt, Artificial Sequence; identical to SEQ ID NO: 5547
  derived and/or modified CDS sequence (opt4) from SFTSV(2015SYSH33)__KT380653.1__N

SEQ ID NO: 5555 - RNA, 738 nt, Artificial Sequence
  derived and/or modified CDS sequence (opt4) from SFTSV(2015SYSH86)__KT380657.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucaucaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5556 - RNA, 738 nt, Artificial Sequence
  derived and/or modified CDS sequence (opt4) from SFTSV(67S)__KP339890.1__N
augagcgaguggagcagaaucgccguggaguucgccgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5557 - RNA, 738 nt, Artificial Sequence
  derived and/or modified CDS sequence (opt4) from SFTSV(6S)__KP339927.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagauucagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5558 - RNA, 738 nt, Artificial Sequence
  derived and/or modified CDS sequence (opt4) from SFTSV(72S)__KP339891.1__N
augagcgaguggagcagaaucgccguggaguucggcgagcagcagcugacccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugagauggcugaaggccaagggcauccugggccccgacggcgugcccagcagagccgccgagguggccgccgccgccuacagaaaccuguga

SEQ ID NO: 5559 - RNA, 738 nt, Artificial Sequence
  derived and/or modified CDS sequence (opt4) from SFTSV(AP01-Korea-13)__KR612072.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5560 - RNA, 738 nt, Artificial Sequence
  derived and/or modified CDS sequence (opt4) from SFTSV(JP03-Korea-13)__KR612079.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcauccccagcagagccgccgagguggccgccgccgccuacagaaaccuguga

SEQ ID NO: 5561 - RNA, 738 nt, Artificial Sequence
  derived and/or modified CDS sequence (opt4) from SFTSV(JP07-Korea-13)__KR612088.1__N
augagcgaguggagcagaaucgccguggaguucggcgagcaccagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5562 - RNA, 738 nt, Artificial Sequence
  derived and/or modified CDS sequence (opt4) from SFTSV(JS2011-13-2)__KR230790.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcagcagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5563 - RNA, 738 nt, Artificial Sequence
  derived and/or modified CDS sequence (opt4) from SFTSV(JS2014-15)__KR230799.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcuggugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5564 - RNA, 738 nt, Artificial Sequence
  derived and/or modified CDS sequence (opt4) from SFTSV(KASJH)__KP663733.1__N
augagcgaguggagcagaaucgccguggaguucggcgagcagcagcugaaccugagcgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5565 - RNA, 738 nt, Artificial Sequence
  derived and/or modified CDS sequence (opt4) from SFTSV(YSH116)__KT721303.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacguguucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5566 - RNA, 738 nt, Artificial Sequence
  derived and/or modified CDS sequence (opt4) from SFTSV(AH-YTY/China/05/2012)__KR017811.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccaccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5567 - RNA, 738 nt, Artificial Sequence
  derived and/or modified CDS sequence (opt4) from SFTSV(DS02/CHN/2013)__KR698319.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagaaggccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5568 - RNA, 738 nt, Artificial Sequence
  derived and/or modified CDS sequence (opt4) from SFTSV(HB2014-13)__KU738908.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccaccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugagauggcugaaggccaagggcauccugggccccgacggcgugcccagcagagccgccgagguggccgccgccgccuacagaaaccuguga

SEQ ID NO: 5569 - RNA, 738 nt, Artificial Sequence
  derived and/or modified CDS sequence (opt4) from SFTSV(HB2014-20)__KU738910.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugaugacccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5570 - RNA, 738 nt, Artificial Sequence
  derived and/or modified CDS sequence (opt4) from SFTSV(LN2012-14)__KF887431.1__N
augagcgagagaagcagaaucgccguggaguucggcgagcagcagcugaaccugaccggccuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccagaacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5571 - RNA, 738 nt, Artificial Sequence
  derived and/or modified CDS sequence (opt4) from SFTSV(NB31/CHN/2013)__KR698325.1__N
augagcgaguggagcagaaucgccguggaguucggcgagcagcagcugaaccugaucgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagaaggccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcaagcccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5572 - RNA, 738 nt, Artificial Sequence
  derived and/or modified CDS sequence (opt4) from SFTSV(QD7)__KR706565.1__N
augagcgaguggagcagaaucgccguggaguucggcgugcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5573 - RNA, 738 nt, Artificial Sequence
  derived and/or modified CDS sequence (opt4) from SFTSV(SDLZP06/2011)__JQ693009.1__N
augagcgaguggagcagaaccgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5574 - RNA, 738 nt, Artificial Sequence
  derived and/or modified CDS sequence (opt4) from SFTSV(ZJZHSH-FDE/China/06/2012)__KR017821.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagaaggccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcgugcuguuccccaacgacgugagagugaaguggcugaaggccaagggcauccugggccccgacggcgugcccagcagagccgccgagguggccgccgccgccuacagaaaccuguga

SEQ ID NO: 5575 - RNA, 738 nt, Artificial Sequence
  derived and/or modified CDS sequence (opt4) from SFTSV(ZJZHSH-FZHR/China/07/2013)__KR017824.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacuggaugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5576 - RNA, 738 nt, Artificial Sequence
  derived and/or modified CDS sequence (opt4) from SFTSV(ZJZHSH-HYC/China/05/2012)__KR017809.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagaaggccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgugggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5577 - RNA, 738 nt, Artificial Sequence
  derived and/or modified CDS sequence (opt4) from SFTSV(SPL003A)__AB817996.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgcccccagcagagccgccgagguggccgccgccgccuacagaaaccuguga

SEQ ID NO: 5578 - RNA, 738 nt, Artificial Sequence
  derived and/or modified CDS sequence (opt4) from SFTSV(SPL077A)__AB985536.1__N
augagcgaguggcccagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5579 - RNA, 738 nt, Artificial Sequence
  derived and/or modified CDS sequence (opt4) from SFTSV(SPL106A)__AB985548.1__N
augagcgacuggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5580 - RNA, 738 nt, Artificial Sequence
  derived and/or modified CDS sequence (opt4) from SFTSV(SPL114A)__AB985552.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggcccccggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5581 - RNA, 738 nt, Artificial Sequence
  derived and/or modified CDS sequence (opt4) from SFTSV(SPL125A)__AB985557.1__N
augagcgaguggagcggcguggccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5582 - RNA, 738 nt, Artificial Sequence
  derived and/or modified CDS sequence (opt4) from SFTSV(SPL160A)__AB985571.1__N
augagcgaguggagcagaaucgccguggaguucggcgagcagcagcugaaccugaccgagcuggaggacuucgccagagagcuggccuacgagggccuggaccccgcccugaucaucaccaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5583 - RNA, 738 nt, Artificial Sequence
  derived and/or modified CDS sequence (opt4) from SFTSV(SPL163A)__AB985573.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucccccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5584 - RNA, 738 nt, Artificial Sequence
  derived and/or modified CDS sequence (opt4) from SFTSV/FTLSV(2011YPQ12)__KF711915.1__N
augagcaaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccaagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcaaggccgccgagguggccgccgccgccuacagaaaccuguga

SEQ ID NO: 5585 - RNA, 738 nt, Artificial Sequence
  derived and/or modified CDS sequence (opt4) from SFTSV/FTLSV(2011YXX9)__KF711898.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugguggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5586 - RNA, 738 nt, Artificial Sequence
  derived and/or modified CDS sequence (opt4) from SFTSV/FTLSV(YPQ2)__KF356519.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccaacggcgugcccagcagagccgccgagguggccgccgccgccuacagaaaccuguga

SEQ ID NO: 5587 - RNA, 738 nt, Artificial Sequence
  derived and/or modified CDS sequence (opt4) from SFTSV/Guertu virus(DXM)__KT328591.1__N
augagcgaguggagcaagaucgccguggaguucggcgagcagcagcugaacgugaucgagcuggaggaguucgccagagagcuggccuacgagggccuggaccccgcccugaucaucaagaagcugaaggaggugggcggcgacgacuggaugagagacaccaaguucaucaucguguucgcccugaccagaggcaacaagauccugaaggccgccggcaagaugagcaacagcggcagcaagagaaucauggcccugcaggagaaguacggccugguggagagagccgagaccagacugagcaucacccccgugagaguggcccagagccugcccaccuggaccugcagcgccgccgccgcccugcaggaguaccugcccgugggccccgccgugaugagccugaaggugagcaacuucccccccgagaugaugugcauggccuucggcagccugauccccgccaccggcgugcccgagagcaccaccaagauccugauggaggccuacagccuguggcaggacgccuucaccaagaccaucaacgugaagaugagaggcgccagcaaggccgagguguacaacagcuucagagacccccugcacgccgccgugaacagcguguucuuccccaacgacgugagacugagauggcugaagagcaagggcauccugggccccgacggccugcccagcaaggccguggagaccgccgccgccgccuacagaaaccuguga

SEQ ID NO: 5588 - RNA, 738 nt, Artificial Sequence
  derived and/or modified CDS sequence (opt4) from SFTSV/Huaiyangshan virus(2010-FQM)__HQ419240.1__N
augagcgaguggagcagaaucgccgugaaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguuccugcccaacgacgugagagugaaguggcugaaggccaagggcauccugggccccgacggcgugcccagcagagccgccgagguggccgccgccgccuacagaaaccuguga

SEQ ID NO: 5589 - RNA, 738 nt, Artificial Sequence
  derived and/or modified CDS sequence (opt4) from SFTSV/Huaiyangshan virus(2010-ZGQ)__HQ419241.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugaugagccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccagaacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5590 - RNA, 738 nt, Artificial Sequence
  derived and/or modified CDS sequence (opt4) from SFTSV/Huaiyangshan virus(S-HGX)__HQ171192.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcaccgccgccgccgcccugaaggaguaccugcccgugggccccgccgugaugaaccugaagguggagaacuacccccccgagaugaugugcauggccuucgagagccugauccccaccgccggcgugagcgaggccaccaccaagacccugauggaggccuacagccuguggcaggacgccuucaccaagaccaucaacguggagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5591 - RNA, 738 nt, Artificial Sequence
  derived and/or modified CDS sequence (opt4) from SFTSV/Huaiyangshan virus(S-HZM)__HQ171193.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccgaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccaccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgaccugagagugaaguggcugaaggccaagggcauccugggccccgacggcgugcccagcagagccgccgagguggccgccgccgccuacagaaaccuguga

SEQ ID NO: 5592 - RNA, 738 nt, Artificial Sequence
  derived and/or modified CDS sequence (opt4) from SFTSV/Huaiyangshan virus(S-WJ)__HQ171191.1__N
augagcgaguggagcagaaucgccguggaguucggcgagcagcagcugaaccugaccgagcuggaggacuucgccagagagcuggccuacgagggccugggccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5593 - RNA, 738 nt, Artificial Sequence
  derived and/or modified CDS sequence (opt4) from SFTSV/Phlebovirus(JS2010-019)__JQ317180.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgaggccgccgccgccgccuacagaaaccuguga

SEQ ID NO: 5594 - RNA, 738 nt, Artificial Sequence
  derived and/or modified CDS sequence (opt4) from SFTSV/Phlebovirus(SD24/China/2010 strain SD24)__HM802205.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugaccgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5595 - RNA, 738 nt, Artificial Sequence
  derived and/or modified CDS sequence (opt4) from SFTSV/Phlebovirus(ZJ1/China/2011)__HE663216.1__N
augagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugagagacaccaaguucaucaucguguucgcccugaccagaggcaacaagaucgugaaggccagcggcaagaugagcaacagcggcagcaagagacugauggcccugcaggagaaguacggccugguggagaaggccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaaggcccugauggaggccuacagccuguggcaggacgccuucaccaagaccaucaacgugaagaugagaggcgccagcaagaccgagguguacagcagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccuguga

SEQ ID NO: 5596 - RNA, 1287 nt, Artificial Sequence
  derived and/or modified CDS sequence (opt3) from ANDV(Chile-9717869)__AF291702.1__N
augagcacccugcaggagcuccaagaaaacaucacagcccacgagcagcagcuugugacugcuagacagaagcugaaagacgcagaaaaggccgucgagguugaucccgacgaugugaauaaauccacguugcaaucuaggcgggcggcuguaucaaccuuagaaacaaagcugggcgagcuaaaacgccagcucgccgaccugguggcagcccagaaacuugcuacuaagccugucgauccaaccgggcuggagccggacgaucauuugaaagaaaagaguagccuccgauacggaaacgugcuggacguuaauuccauugaucuggaggaacccucuggucagacagcagacuggaaagccauaggcgcuuauauccucggguucgccauuccuaucauuuuaaaggcgcuguacaugcuuucgacccguggaagacaaacugugaaagauaacaagggcacaaggauccgguuuaaggacgauagcucauucgaggaggucaaugguauacgcaaaccaaagcacuuguaugugaguaugcccaccgcacaguccacgaugaaagccgaagagaucacuccugggagauuuaggaccauugcuugcggacuguucccagcccagguaaaggcacggaacaucauuucucccguuaugggcgugaucggcuuuggguucuuugucaaagacuggauggaccgcauagaagaguuccuagcugccgaauguccuuuucucccaaagccgaaaguggcgagcgaggccuucauguccacaaauaagauguacuuucugaaccgacagagacaagugaaugagucaaagguccaggauauuaucgaccuuauugaucaugcagaaacugagagugcuacccuguucacagaaaucgccacgccccacagcguuuggguguuugcuugcgccccugacagguguccacccaccgcauuguauguagccggagugccugagcucggugcuuucuucucuauccugcaggauaugcggaacacuauuauggcguccaaaucagucggcacagcagaagagaaguuaaagaagaaaagcgccuuuuaccaaaguuaucugcgucgcacccagucuauggggauacagcucgaccagaagaucauuauccuuuacaugcuguccuggggaaaggaggcugugaaucauuuccacuugggcgaugacauggauccagaacuaagacaacuggcccagagccucauagacacuaaaguuaaggagauuucgaaccaggaaccccugaaacuuuga

SEQ ID NO: 5597 - RNA, 1287 nt, Artificial Sequence
  derived and/or modified CDS sequence (opt3) from ANDV(Nort)__AF325966.1__N
augagcacccugcaggagcuccaagaaaacaucacagcccacgagcagcagcuugugacugcuagacagaagcugaaagacgcagaaaagacggucgagguugaucccgacgaagugaauaaauccaccuugcaaucuaggcgggccgcgguaucaacauuagagacuaagcugggcgagcuaaaacgccagcucgcugaucugguggccgcacagaaacuugccaccaagccugucgacccaacagggcuggaaccggaugaccauuugaaggagaagaguagccuccgauacggaaacgugcuggauguuaauuccauugaccuggaggaacccucuggucagaccgcugauuggaaagcaauaggcgccuauauccucggguucgcuauuccuaucauuuuaaaggcccuguacaugcuuucgacucguggaagacaaacagugaaagacaacaagggcaccaggauccgguuuaaggaugacagcucauucgaggaagucaaugguauacgcaaaccaaagcacuuguaugugaguaugcccacggcgcaguccacuaugaaagcagaggaaaucaccccugggagauuuaggacaauugccugcggacuguucccagcucagguaaaggcccggaacaucauuucucccguuaugggcgugaucggcuuuagcuucuuugucaaagauuggauggagcgcauagaagacuuccuagcagcugaguguccuuuucucccaaagccgaaagcccuguccgaggcguucauggccacuaauaaggcauacuuucuuaaccgacagagacaagugaaugacucaaaggugcaggauauugucgaccugaucgaucaugcugaaauugagagugccaccuuguucacagacaucgcuacgccccacagcguuuggguguuugccugcgcaccugauagguguccacccaccgcccucuauguagcuggggugccugaacugggagcguucuucgcaaucuuacaggacaugcggaacacuauuauggccucuaaauccgucgguacagcugaggaaaagcugaaaaagaaaucagccuuuuaccaaagcuaucuccgucgcacccaguacaugggcauacagcuugaucagaagaucauuauccuguacauguugaguugggggaaggaggcagugaaucauuuccaccuaggagacgauauggacccagagcugagacaacucgcccagucucugauagauacuaaaguuaaggaaauuuccaaccaggagccccuuaaacuguga

SEQ ID NO: 5598 - RNA, 1287 nt, Artificial Sequence
  derived and/or modified CDS sequence (opt3) from ANDV(CHI-7913)__AY228237.1__N
augagcacccugcaggagcuccaagaaaacaucacagcccacgagcagcagcuugugacugcuagacagaagcugaaagacgcagaaaaggccgucgagguugaucccgacgaugugaauaaauccacguugcaaaacaggcgggcggcuguaucuaccuuagaaacaaagcugggcgagcuaaaacgccagcucgccgaccugguggcagcccagaaacuugcuacuaagccugucgauccaaccgggcuggagccggacgaucauuugaaagaaaagucaagucuccgauacggaaaugugcuggacguuaacagcauugaucuggaggaacccuccggucagacagcagacuggaaagccauaggcgcuuauauccucggguucgccauuccuaucauuuuaaaggcgcuguacaugcuuucuacccguggaagacaagcagugaaagauaauaagggcacuaggauccgguuuaaggacgauucgucauucgaggaggucaacgguauacgcaaaccaaagcacuuguaugugagcaugcccacagcccagaguaccaugaaagcugaagagaucacgccugggagauuuaggacuauugccugcggacuguucccagcacagguaaaggcucggaauaucauuucccccguuaugggcgugaucggcuuuggguucuuugucaaagacuggauggaccgcauagaagaguuccuagccgcggaauguccuuuucucccaaagccgaaaguggccucugaggcauucaugagcaccaacaagauguacuuucugaaucgacagagacaagugaacgaguccaagguccaggauauuaucgaccuuauugaucaugcugaaacagagucagccacucuguucaccgaaaucgcuacaccccacaguguuuggguguuugccugcgcaccugacagguguccacccaccgccuuguauguagcuggagugccugagcucggugcguucuucagcauccugcaggauaugcggaauacgauuauggcaucuaaauccgucggcacugccgaagagaaguuaaagaagaaaucagcuuuuuaccaaagcuaucugcgucgcacacagaguauggggauacagcucgaccagaagaucauuauccuuuacaugcugucuuggggaaaggaggccgugaaccauuuccacuugggcgaugacauggauccagaacuaagacaacuggcacagucccucauagacaccaaaguuaaggagauuagcaaucaggaaccccugaaacuuuga

SEQ ID NO: 5599 - RNA, 1287 nt, Artificial Sequence
  derived and/or modified CDS sequence (opt3) from ANDV(9718133)__AF482712.1__N
augagcacccugcaggagcuccaagaaaacaucacagcccacgagcagcagcuugugacugcuagacagaagcugaaagacgcagaaaaggccgucgagguugaucccgacgaugugaauaaauccacguugcaaaacaggcgggcggcuguaucuaccuuagaaacaaagcugggcgagcuaaaacgccagcucgccgaccugguggcagcccagaaacuugcuacuaagccugucgauccaaccgggcuggagccggacgaucauuugaaagaaaagucaagucuccgauacggaaaugugcuggacguuaacagcauugaucuggaggaacccuccggucagacagcagacuggaaagccauaggcgcuuauauccucggguucgccauuccuaucauuuuaaaggcgcuguacaugcuuucuacccguggaagacaaacugugaaagauaauaagggcacaaggauccgguuuaaggacgauucgucauucgaggaggucaacgguauacgcaaaccaaagcacuuguaugugagcaugcccaccgcacagaguacgaugaaagccgaagagaucacuccugggagauuuaggaccauugcuugcggacuguucccagcccagguaaaggcacggaauaucauuucccccguuaugggcgugaucggcuuuggguucuuugucaaagacuggauggaccgcauagaagaguuccuagcugccgaauguccuuuucucccaaagccgaaaguggcgucugaggccuucaugagcacaaacaagauguacuuucugaaucgacagagacaagugaacgaguccaagguccaggauauuaucgaccuuauugaucaugcagaaacugagucagcuacccuguucacagaaaucgccacgccccacaguguuuggguguuugcuugcgccccugacagguguccacccaccgcauuguauguagccggagugccugagcucggugcuuucuucagcauccugcaggauaugcggaauacuauuauggcgucuaaauccgucggcacagcagaagagaaguuaaagaagaaaucagccuuuuaccaaagcuaucugcgucgcacccagaguauggggauacagcucgaccagaagaucauuauccuuuacaugcugucuuggggaaaggaggcugugaaccauuuccacuugggcgaugacauggauccagaacuaagacaacuggcccagucccucauagacacuaaaguuaaggagauuagcaaucaggaaccccugaaacuuuga

SEQ ID NO: 5600 - RNA, 1278 nt, Artificial Sequence
  derived and/or modified CDS sequence (opt3) from Araraquara virus(9480)__KP202360.1__N
augagcaaccugcaggagcuccaagaaaauaucaccgcccacgagcagcagcuugugacagcuagacagaagcugaaagacgcagaaaaggccgucgauguugaccccgaugaggugaacaaauccacuuugcaaggcaggcgggcggcuguaucuacguuagaaaccaagcugggggagcuaaaacgccagcucgccgaccugguggcagcccagcgacuugcuucaaagccugucgauccaacaggaauugagccggacgaucaucugaaggagaaaaguagcuugcguuacgguaaugugcucgacguuaacuccauagaucuggaagaacccucuggccagacugcagacuggaaggccaucggggcuuauauucugggauucgccaucccuauuauccucaaagcguuauacaugcugucgaccagaggcaggcaaacagugaaggauaauaaagguacccggauacgcuuuaaggacgauagcucauucgaggaggucaacgggaucagaaagccaaaacaccuuuauauuaguaugcccacugcacaguccacaaugaaggccgaagagaucaccccuggaagguuucggacgauugcuugcggcuuguucccagcccaggugaaagcacgcaauaucauaucucccguaaugggcguuauuggguuugcuuucuuugugaaggacuggauggaacgaaucgaggacuuccuggccagcgaauguccuuuucuaccaaaaccgaagaaccccuccgaggcguucauggccacuaauaaagcauacuuucucaacagacagaagcaagucgaugagucacaggugccugacauuguggaucugaucgaccaugcugaagccgagagugcuacccuuuucaaggaaaucgccagcccacacucugucuggguuuuugcaugcgcccccgauagguguccuccaacagcucuguauguggcgggaaugcccgaguugggugcauucuucgccauucuccaggacaugcggaauacuauaauggcuuccaaaucaguaggcaccgccgaagagaagcugaaaaagaaaagcgcauuuuaccaaaguuauuuacgucgcacacagucuauggggauccagcuggaucagaagauuaucauacucuacaugcuuuccuggggaaaggaggccgugaaccauuuccaccugggcgacgauauggacccggaauugagacaacuagcucagagccugauugauaccaaagucaaggagucgcagacgaaaucucucuga

SEQ ID NO: 5601 - RNA, 1287 nt, Artificial Sequence
  derived and/or modified CDS sequence (opt3) from Araraquara-like virus(P5/Cajuru)__EF571895.1__N
augagcaaccugcaggagcuccaagaaaauaucaccgcccacgagcagcagcuugugacagcuagacagaagcugaaagacgcagaaaaggccgucgauguugaccccgaugaggugaacaaauccacuuugcaaggcaggcgggcggcuguaucuacguuagaaaccaagcugggggagcuaaaacgccagcucgccgaccugguggcagcccagcgacuugcuucaaagccugucgauccaacaggaauugagccggacgaucaucugaaggagaaaaguagcuugcguuacgguaaugugcucgacguuaaccccauagaucuggaagaaccuuccggccagacugcagacuggaaggccaucggggcuuauauucugggauucgccaucccaauuauccucaaagcguuauacaugcugucuaccagaggcaggcaaacagugaaggauaauaaagguacccggauacgcuuuaaggacgauucgucauucgaggaggucaacgggaucagaaagcccaaacaccuuuauauuagcaugccuacugcacagaguacaaugaaggccgaagagaucaccccaggaagguuucggacgauugcuugcggcuuguuccccgcccaggugaaagcacgcaauaucauauccccuguaaugggcguuauuggguuuggauucuuugugaaggacuggauggaacgaaucgaggacuuccuggcuucugaauguccauuucuaccgaaacccaagaacccuagcgaggccuucauggcgacuaauaaagccuacuuucucaacagacagaagcaagucgaugagucccaggugccagacauuguggaucugaucgaccaugcagaagcugagucagccacccuuuucaaggaaaucgcuaguccccacagcgucuggguuuuugccugcgcaccugauagguguccacccacagcccuguauguggcugguuugccggagcucggcgcguucuucgcaauucugcaggacaugcggaauacuauaauggccucuaaauccguagggaccgcugaagagaagcugaaaaagaaaucagccuuuuaccaaagcuauuuacgucgcacacagaguaugggaauccagcucgaucagaagauuaucauacuuuacaugcugucuuggggcaaggaggcagugaaccauuuccacuugggugacgauauggacccugaacuaagacaacuggcccagucccucauugauaccaaagucaaggagaucagcaaucaggggccccugaaacuuuga

SEQ ID NO: 5602 - RNA, 1287 nt, Artificial Sequence
  derived and/or modified CDS sequence (opt3) from BMJV(Oc22531)__AF482713.1__N
augagcacccugcaggagcuccaagaaaacaucacagcccacgagcagcagcuugugacugcuagacagaagcugaaggacgcagaaaagacggucgagguugaucccgacgaagugaauaaauccaccuugcaaucuaggcgggccgcgguaucaacauuagagacuaagcugggcgagcuaaaacgccagcucgcugaucugguggccgcacagaaacuugccaccaagccugucgacccaacagggcuggaaccggaugaccauuugaaggagaagaguagccuccgauacggaaacgugcuggauguuaauuccauugaccuggaggaacccucuggucagaccgcugauuggcguucgauaggcgcauauauccucggguucgccauuccuaucauuuuaaaagcucuguacaugcuuucaacuagaggaaggcaaacagugaaggacaacaaaggcacccggauccgcuuuaaggaugacagcaguuucgaggaagucaaugguauaagaaagccaaaacacuuguauguguccaugcccacggcccagucuacuaugaaggcggaggaaaucaccccugggagguuucggacaauugcaugcggacuguucccagcccagguaaaagcucgcaacaucauuagccccguuaugggcgugaucggcuuuuccuucuuugucaaggauuggauggagcgaauagaagacuuccuagccgcagaguguccuuuucucccaaaaccgaaggcucccucagaggccuucauggcgacuaauaaagccuacuuucugaacagacagaggcaagugaaugaaaguaaggugcaggacauugucgaucuuaucgaccaugcagagaccgaaagcgcuacacuguucaccgauauugccacgccucacucuguuuggguguuugcuugcgccccagaccggugucccccuacugcauuguauguagccggggugccagagcucggagcuuucuucgcgauccugcaggauaugcguaacacaaucauggcauccaagucagucgguaccgccgaagagaaauuaaagaaaaagagcgcuuuuuaccaaaguuaucugcgcagaacucagucuaugggcauucagcucgaccagaaaauaaucauucuuuacaugcuguccugggggaaggaggccgugaaucauuuccacuugggagaugacauggaucccgaacuaaggcaacuggcacagagccucaucgacacaaagguuaaagagauaucgaaccaggaaccgcugaaacuuuga

SEQ ID NO: 5603 - RNA, 1287 nt, Artificial Sequence
  derived and/or modified CDS sequence (opt3) from LECV(22819)__AF482714.1__N
augagcacccugcaggagcuccaagaaaacaucacagcccacgagcagcagcuugugacugcuagacagaagcugaaggacgcagaaaagacggucgagguugaucccgacgaagugaauaaauccaccuugcaaucuaggcgggccgcgguaucaacauuagagacuaagcugggcgagcuaaaacgccagcucgcugaucugguggccgcacagaaacuugccaccaagccugucgacccaacagggcuggaaccggaugaccauuugaaggagaagaguagccuccgauacggaaacgugcuggauguuaauuccauugaccuggaggaacccucuggucagaccgcugauuggcguucgauaggcgcauauauccucggguucgccauuccuaucauuuuaaaagcucuguacaugcuuucaacuagaggaaggcaaacagugaaggacaacaaaggcacccggauccgcuuuaaggaugacagcaguuucgaggaagucaaugguauaagaaagccaaaacacuuguauguguccaugcccacggcccagucuacuaugaaggcggaggaaaucaccccugggagguuucggacaauugcaugcggacuguucccagcccagguaaaagcucgcaacaucauuagccccguuaugggcgugaucggcuuuuccuucuuugucaaggauuggauggagcgaauagaagacuuccuagccgcagaguguccuuuucucccaaaaccgaaggcucccucagaggccuucauggcgacuaauaaagccuacuuucugaacagacagaggcaagugaaugaaaguaaggugcaggagauugucgaccuuaucgaucaugcagaaaccgagagcgcuacacuguucaccgacauugccacgccucacucuguuuggguguuugcuugcgccccagaucggugucccccuacugcauuguauguagccggggugccagaacucggagcuuucuucgcgauccugcaggacaugcguaacacaaucauggcauccaagucagucgguaccgccgaggagaaauuaaagaaaaagagcgcuuuuuaccaaaguuaucugcgcagaacucagucuaugggcauucagcucgaucagaaaauaaucauucuuuacaugcuguccugggggaaggaagccgugaaucauuuccacuugggagacgauauggaccccgagcuaaggcaacuggcacagagccucaucgauacaaagguuaaagaaauaucgaaccaggagccgcugaaacuuuga

SEQ ID NO: 5604 - RNA, 1287 nt, Artificial Sequence
  derived and/or modified CDS sequence (opt3) from MCLV(13796)__AF482716.1__N
augagcaaccugcaggagcuccaagaaaauaucaccgcccacgagcagcagcuugugacagcuagacagaagcugaaagacgcagaaaaggccgucgauguugaccccgaugaggugaacaaauccacuuugcaaggcaggcgggcggcuguaucuacguuagaaaccaagcugggggagcuaaaacgccagcucgccgaccugguggcagcccagaaacuugcuacaaagccugucgauccaacuggaauugagccggacgaucaucugaaagaaaagucaaguuugcgauacgguaaugugcucgacguuaacagcauagaucuggaggaacccuccggccagaccgcagacuggaaagccaucggggcuuauauucugggauucgccaucccuauuauccucaaggcguuauacaugcugucuacacguggcagacaaaccgugaaagauaauaaggguacuaggauacgguuuaaggacgauucgucauucgaggaggucaacgggauccgcaaaccaaagcaccuuuauauuagcaugcccacagcacagaguaccaugaaagccgaagagaucacgccuggaagauuuaggacuauugugugcggcuuguucccagcucagguaaaggcccggaauaucauaucccccguuaugggcgugauuggguuuucuuucuuugucaaagacuggauggaacgcaucgagggauuccuggcagcugaauguccuuuucuaccaaagccgaaaaccgccgcggagacauucauggccacuaacaaggcauacuuuuucaaucgacagagacaaguggacgagagccaggugcccgauauugucgaacucaucgaccaggcugaguccgaaucagccacccuguuuacagagaucgcuaguccucauagcguuuggguguucgccugcgcaccagauaggugucccccuaccgcccuuuauguagcuggugugccagaacugggcgcguucuuugcaauuuugcaagacaugcggaacacgauaauggccucuaaguccgucgggacugcugaggagaaacucaagaaaaagucagccuucuaccagagcuaucugcgucgcacacagaguaugggaauccaguuagaucaaaagauuaucauacuguacaugcucucuuggggcaaggaagcagugaaucacuuucaucuuggugacgauauggaccccgagcugagacaguuggcccaggcucuaauugauaccaagguuaaagaaaucuccaaccaggagccgcugaagcucuga

SEQ ID NO: 5605 - RNA, 1287 nt, Artificial Sequence
  derived and/or modified CDS sequence (opt3) from Neembucu(Neembucu)__DQ345763.1__N
augagcacccugcaggagcuccaagaaaacaucacagcccacgagcagcagcuugugacugcuagacagaagcugaaagacgcagaaaagacggucgagguugaucccgacgaagugaauaaauccaccuugcaaucuaggcgggccgcgguaucaacauuagagacuaagcugggcgagcuaaaacgccagcucgcugaucugguggccgcacagaaacuugccacccgaccugucgacccaacagggcuggaaccggaugaccauuugaaggagaagaguagccuccguuacggaaacgugcuggauguuaauuccauugaccuggaggaacccucuggucagaccgcugauuggagaucgauaggcgcauauauccucggguucgccauuccuaucauuuuaaaggcucuguacaugcuuucaacuaggggacggcaaacagugaaagacaacaagggcacccgcaucagauuuaaagaugacagcaguuucgaggaagucaaugguauaaggaagccaaagcacuuguauguguccaugcccacggcccagucuacuaugaaagcggaggaaaucaccccugggcggcugcgcacaauugcaugcggacuauuuccagcccagguaaaggcucgaagcaucauuucccccguuaugggcgugaucggcuucucauuuuucgucaaagauuggauggagagaauagaagacuuucucgccgcagaguguccuuuccugccaaagccgaaagcucccagugaggccuuuauggcgacuaacaaggccuacuuccuuaauaggcagcggcaagugaacgaaagcaaagugcaggacauugucgaucugaucgaccaugcagagaccgaaucugcuacauuguuuaccgauauugccacgccucacuccguuuggguguucgcuugcgccccagaccguugucccccuacugcacucuauguagccggggugccagagcugggagcguuuuucgcuaucuuacaggauaugcgcaauacaaucauggcaucaaagagcgucgguaccgccgaagagaagcugaaaaagaaaagugcuuucuaccaaucuuaucucagaaggacucaguccaugggcauucagcuugaccagaagauaaucauucuguacauguugagcugggggaaagaggccgugaaccauuuucaccuaggagaugacauggaucccgaacugcggcaacucgcacagucgcugaucgacacaaagguuaaggagauaucuaaucaggaaccgcuuaaacuguga

SEQ ID NO: 5606 - RNA, 1287 nt, Artificial Sequence
  derived and/or modified CDS sequence (opt3) from ORNV(22996)__AF482715.1__N
augagcacccugcaggagcuccaagaaaacaucacagcccacgagcagcagcuugugacugcuagacagaagcugaaagacgcagaaaagacggucgagguugaucccgacgaagugaauaaauccaccuugcaaucuaggcgggccgcgguaucaacauuagagacuaagcugggcgagcuaaaacgccagcucgcugaucugguggccgcacagaaacuugccaccaagccugucgacccaacagggcuggaaccggaugaccauuugaaggagaagaguagccuccgauacggaaacgugcuggauguuaauuccauugaccuggaggaacccucuggucagaccgcugauuggaaagcaauaggcgccuauauccucggguucgcuauuccuaucauuuuaaaggcccuguacaugcuuucgacucguggaagacaaacagugaaagacaacaagggcaccaggauccgguuuaaggaugacagcucauucgaggaagucaaugguauacgcaaaccaaagcacuuguaugugaguaugcccacggcgcaguccacuaugaaagcagaggaaaucaccccugggagauuuaggacaauugccugcggacuguucccagcucagguaaaggcccggaacaucauuucucccguuaugggcgugaucggcuuuagcuucuuugucaaagauuggauggagcgcauagaagacuuccuagcagcugaguguccuuuucucccaaagccgaaagcccuguccgaggcguucauggccacuaauaaggcauacuuucuuaaccgacagagacaagugaaugacucaaaggugcaggauauugucgaccugaucgaucaugcugaaauugagagugccaccuuguucacagacaucgcuacgccccacagcguuuggguguuugccugcgcaccugauagguguccacccaccgcccucuauguagcuggggugccugaacugggagcguucuucgcaaucuuacaggacaugcggaacacuauuauggccucuaaauccgucgguacagcugaggaaaagcugaaaaagaaaucagccuuuuaccaaagcuaucuccgucgcacccagaguaugggcauacagcuugaucagaagaucauuauccuguacauguugucuugggggaaggaggcagugaaucauuuccaccuaggagacgauauggacccagagcugagacaacucgcccagucccugauagauacuaaaguuaaggaaauuagcaaccaggagccccuuaaacuguga

SEQ ID NO: 5607 - RNA, 1287 nt, Artificial Sequence
  derived and/or modified CDS sequence (opt3) from PRGV(14403)__AF482717.1__N
augagcacccugcaggagcuccaagaaaacaucacagcccacgagcagcaucuugugacugcuagacagaagcugaaggacgcagaaaagacggucgagguugaucccgacgaagugaauaaauccaccuugcagucuaggcgggccgcgguaucaacauuagagacuaagcugggcgagcuaaaacgccaacucgcugaucugguggccgcacagaaacuugccgcuaagccugucgacccaaccgggcuggaaccggaugaccacuugaaggagaagaguagccuccgauacggaaacgugcuggauguuaauuccauugaccuggaggaacccucuggucagacagcagauuggaaagccauaggcgcuuauauccucggguucgccauuccuaucauuuuaaaggcgcuguacaugcuuucgacccguggaagacagacugugaaagacaacaagggcacaaggauccgguuuaaggaugacagcucauucgaggaagucaaugguauacgcaaaccaaagcauuuguaugugaguaugcccaccgcacaauccacgaugaaagccgaggaaaucacuccugggagauuuaggaccauugcuugcggacuguucccagcccagguaaaggcacggaacaucauuucucccguuaugggcgugaucggcuuuagcuucuuugucaaagauuggauggagcgcauagaagacuuccuagcugccgaguguccuuuucucccaaagccgaaaacaacuuccgaggcguucaugucaaccaauaaggccuacuuucugaaccgacagagacagguggacgaaagucaagugcccgauauugcagagcuuaucgaacaggcugagagcgaaucugccacacuguucaccgagauugcuuccccucacucagucuggguuuuugccugcgcaccagacaggugucccccuacggccuuguauguggcugggguaccagagcucggagcguucuucgcaauccugcaggauaugcggaauacuaucauggccagcaagaguguggguacagcugaagagaaauuaaagaaaaagucugccuuuuaccaauccuaucugcgucgcacccagagcaugggcauucagcucgaccagaaaauaaucauucuuuacaugcugucgugggggaaggaagcagucaaccauuuccacuugggagaugacauggaucccgagcuaagacaacuggcccaggcucucaucgacacuaaggugaaagaaauaucuaaucaggagccgcugaaacuuuga

SEQ ID NO: 5608 - RNA, 1287 nt, Artificial Sequence
  derived and/or modified CDS sequence (opt3) from TUNV(FVB554)__JF750419.1__N
augagcaaccugcaggagcuccaagaaaauaucaccgcccacgagcagcagcuugugacagcuagacagaagcugaaagacgcagaaaaggccgucgagauggaucccgacgauguuaacaaauccacuuugcaaucuaggcgggcggcugugucaacguuagaaaccaagcugggcgagcuaaaacgccagcucgccgacaugguagcagcccagaagcuggcuacaaagccuguggauccaacugggcuugagccggacgaucaucugaaagaaaagaguagcuugcgauacggaaauguccucgacgugaacuccauugaucuggaggaacccucuggucagaccgcagacuggaaaucgauaggcgccuauauccugggguucgcuauuccuaucauucucaaggccuuauacaugcugucaacacguggaagacaaaccguuaaagauaauaagggcacuaggauccgguuuaaggacgauagcaguuucgaggaggugaacgguauacgcaaaccaaagcaccuuuaugucuccaugcccacagcgcagucuaccaugaaagcagaagagaucacgccugggagauuuaggacuauugccugcggauuguucccagcucaggugaaggcccggaauaucauuagccccguaaugggcguuaucggcuuuuccuucuuugugaaagacuggauggaacgcauagaggacuuccuggcagaugaauguccuuuucuaccaaagccgaaaucacccagugaggcuuucauggccaccaacaaggcguacuuucucaaucgacagagacaagucaacgacagcaaggugcaggauauuguggaccugaucgaucaugccgagacagaaucugcaacucuuuucaccgacauugcuacaccucacuccgucuggguuuuugccugcgcuccagauaggugucccccuaccgcccuguauguggcagggguaccagaguugggagccuucuucgcuauccuccaggacaugcggaauacgaucauggcgucaaaaagcguggguacugcagaagagaagcugaaaaagaaaagugccuuuuaccaaucuuauuuacgucgcacacaguccaugggcauucagcuggaucagaagauaaucauucucuacaugcuuagcugggggaaggaagcugucaaccauuuccaccugggagacgauauggaccccgaguugagacaacuagcccaggcacugaucgacaccaaagugaaggagauaucgaaucaggaaccgcucaaacuguga

SEQ ID NO: 5609 - RNA, 1287 nt, Artificial Sequence
  derived and/or modified CDS sequence (opt3) from BCCV(BCCV)__AB689163.1__N
augagcaaccugaaggaggugcaggacaauaucaccacacacgaacaacagcucgucgccgcuagacagaaacuuaaggaugcagagaggacuguuggcguggaccccgaugacguaaacaaauccacgcugcagaaucggcgcgccgcggugucugcuuuggaagccaagauuggggaguuaaaacgacaacuggcagaucuagucgccgcucagaagcucgcaaccaagucaguggacccuacaggaauagaaccagaugaccaucugaaagagaagaguagccuucguuacgguaacguucuggaugucaauuccaucgacuuggaggaaccgucuggccagacugccgauuggaaagcuauugggaccuauauccucucguucgugcugcccauugugcugaaggcccucuacauguuaucaacaagaggaaggcagaccguaaaagagaacaagggcacucggauccgcuuuaaggacgauagcaguuaugaagacguuaaugguauaagaaaaccuaagcaccuguacgugucccuuccaacagcgcaaucuaccaugaaagcagacgagaucacgcccgggagguuccggacuauugucugcggauuguuuccugcccagaucaaggcucgcaacauuaucagcccagugaugggcgugauaggcuucuccuuuuucgucaaagauuggguugacaagauugaggauuuucugcgagccgaaugucccuuccuaccuaaaccaagagcacaggcugagucauuucucaguaccaauggggccuauuucaugaacaggcagacacaaguggaagagagcaagguacaggacauccuggaucuuauugacacugcggaaucuggaggugccacccuguuugauaauaucgcauccccgcagucagcuuggaucuucgccugcgcucccgaccgguguccuccaacagccuuguacguggcaggcguccccgagcucggggccuuuuucagcauucugcaagauaugcguaacaccauaauggcuaguaagucugugggaacggcggaggaaaaauuaaagaaaaaguccgcauucuaucagagcuaccugcgcagaacucagucgaugggcauccagcucgaccagaaaauuaucauacuuuacaugauuaauugggguaaggaggccguuaaccauuuucaccugggggaugacauggacccugaauugaggcaacuagcucaggcccugguggauacaaaggucaaagagaucucuaaucaggaaccacucaagaucuga

SEQ ID NO: 5610 - RNA, 1287 nt, Artificial Sequence
  derived and/or modified CDS sequence (opt3) from BCCV(BCCV)__L39949.1__N
augagcaaccugaaggaggugcaggacaauaucaccacacacgaacaacagcucgucgccgcuagacagaaacuuaaggaugcagagaggacuguugaaguggaccccgaugacguaaacaaauccacgcugcagaaucggcgcgccgcggugucugcuuuggaggccaagauuggcgaauuaaaacgacaacuggcagaucuagucgccgcucagaagcucgcaaccaagucaguggacccuacagggauagagccagaugaccaucugaaagagaagaguagccuucguuacggaaacguucuggaugucaauuccaucgacuuggaggaaccgucuggucagacugccgauuggaaagcuauuggcaccuauauccucucguucgugcugcccauugugcugaaggcccucuacauguuaucaacaagagggaggcagaccguaaaagaaaacaagggaacucggauccgcuuuaaggacgauagcaguuaugaggacguuaauggcauaagaaaaccuaagcaccuguacgugucccuuccaacagcgcaaucuaccaugaaagcagacgagaucacgcccgguagguuccggacuauugucugcggguuguuuccugcccagaucaaggcucgcaacauuaucagcccagugaugggagugauaggcuucuccuuuuucgucaaagauuggguugacaagauugaagauuuucugcgagccgagugucccuuccuaccuaaaccaagagcacaggcugaaucauuucucaguaccaauggcgccuauuucaugaacaggcagacacaaguggaggaaagcaagguacaggacauccuggaucuuauugacacugcggagucugggggagccacccuguuugauaauaucgcauccccgcagucagcuuggaucuucgccugcgcucccgaccgguguccuccaacagccuuguacguggccgguguccccgagcucggcgcauuuuucagcauucugcaagauaugcguaacaccauaauggcuaguaagucuguggggacggcggaagagaaauuaaagaaaaaguccgcauucuaucagagcuaccugcgcagaacucagucgaugggaauccagcucgaccagaaaauuaucauacuuuacaugauuaauuggggcaaggaagccguuaaccauuuucaccugggugaugacauggacccugaguugaggcaacuagcucaggcccugguggauacaaaggucaaagaaaucucuaaucaggagccacucaagaucuga

SEQ ID NO: 5611 - RNA, 1290 nt, Artificial Sequence
  derived and/or modified CDS sequence (opt3) from DOBV(DOBV/Ano-Poroia/Afl9/1999)__NC_005233.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcaguaugaaagccgaugagauuacccccggccgguuccgcacugcuaucugcggcuuguacccugcccaggugaaggcgcgaaaucugauauccccagucaugucugugauuggguuucuagcacucgccaaaaacuggacagaaagaguagaggaauggcuggaccuucccuguaagcuguugagcgagccuuccccaaccucacucacgaaaggaccgaguacuaauagggauuaucugaaccagcggcagggugcuuuagccaagauggaaaccaaggaggcacaagcuguucguaaacacgccaucgacgcgggcugcaaucugauugaucauaucgacagccccucuuccaucuggguguucgccggggcaccugaucgcuguccacccacaugccucuuuauugcuggaauggccgagcuuggcgcuuucuuugccguccugcaggacaugagaaacacuauaauggcaucaaagaccaucgguacaagcgaagagaaauugaagaaaaagaguucuuucuaccaguccuaucuaaggcggacccaaagcauggggauucagcuggaucagcgaaucauagugcucuuuaugguggacuggggaaaggaagccgucgacucguuccaccugggcgaugacauggauccugagcuucgcggccuggcucaggcguugauugaccaaaaaguuaaggaaaucucuaaucaggagccacucaaacuguga

SEQ ID NO: 5612 - RNA, 1290 nt, Artificial Sequence
  derived and/or modified CDS sequence (opt3) from DOBV(DOB/Saaremaa/160V)__AJ009773.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuauagcgcagucaauccaagggaagauugaugaguuacgccgacagcuggcugaccguguugccgcaggaaagaacaucgguaaagaaagagauccuacaggccuagacccaggggaucaucucaaggagaaaaguaugcugagcuauggaaaugugauugaccuuaaccaccuggauaucgacgaaccgacuggccagacggccgauugguuguccauaguaaucuaccucaccucuuucgugguccccauucugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuguuugcggcuuguacccugcccaggugaaggcgcgaaaccugauaucuccagucaugagcgugauuggguuucuaacacucgccaaaaauuggaccgaaagaguagaggaauggcuggaccuucccuguaagcuguuguccgagccuucaccaacgagucucacuaaaggaccgagcaccaacagggauuaucugucucagcggcagggugcauuagcuaagauggaaacaaaggaggcccaaguugugcguaaacacgcaaucgacgcuggcugcaauauuaucgaucauaucgacucccccucaagcauuugggucuucgccggggcgccugaucgcuguccacccacuugccuguuuauagccggaauggcagagcucggcgcuuucuuugccgugcuucaggacaugagaaacaccaucauggcuaguaagacaauugguaccucugaagagaaacugaggaagaaauccagcuucuaccagucguauuugcggcgaacgcaaucuauggggauccagcuagaucagcgcauaauugugcuguuuaugaucgaauggggaaaggaggccgucgacuccuuccaccucggcgacgauauggacccugaaaucagaucacuggcacaggcccuuauugaucaaaagguuaaagagaucaguaaucaggagccacugaaguuguga

SEQ ID NO: 5613 - RNA, 1290 nt, Artificial Sequence
  derived and/or modified CDS sequence (opt3) from DOBV(Slovakia/400Af/98)__AY168576.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcaguaugaaagccgaugagauuacccccggccgguuccgcacugcuaucugcggcuuguacccugcccaggugaaggcgcgaaaucugauauccccagucaugucugugauuggguuucuagcacucgccaaaaacuggacagaaagaguagaggaauggcuggaccuucccuguaagcuguugagcgagccuuccccaaccucacucacgaaaggaccgaguacuaauagggauuaucugaaccagcggcagggugcuuuagccaagauggaaaccaaggaggcacaagcuguucguaaacacgccaucgacgcgggcugcaaucugauugaucauaucgacagccccucuuccaucuggguguucgccggggcaccugaucgcuguccacccacaugccucuuuauugcuggaauggccgagcuuggcgcuuucuuugccguccugcaggacaugagaaacacuauaauggcaucaaagaccaucgguacaagcgaagagaaauugaagaaaaagaguucuuucuaccagucccuacugaggcggacccaaagcauggggauucagcucgaucagcgaaucauagugcuguuuaugguggacuggggaaaggaagccgucgacucguuccaccuuggcgaugacauggauccugagcugcgcggcuuggcucaggcgcucauugaccaaaaaguuaaggaaaucucuaaucaggagccacugaaauuauga

SEQ ID NO: 5614 - RNA, 1290 nt, Artificial Sequence
  derived and/or modified CDS sequence (opt3) from DOBV(Slovakia-856-Aa)__AJ269549.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcuauuugcggcuuguacccugcccaggucaaggcgcgaaaccuggugagcccaguaauguccguuaucggcuuuauggcacuagccaaaaauuggacagaaagaguggaggaauggcucgaccugcccuguaaacuucugucagagccuaguccaaccagcuugacgaaggggccgucuacuaacagggauuaucucaaucagcggcagggagcucuggccaagauggaaaccaaggaggcacaagcuguccguaaacacgccauagacgcggguugcaacauuaucgaucauauugacucccccucaagcaucuggguguucgccccugcaccagaucgcugucccccuacaugcuuauuuaucgcuggcauggccgagcugggggcuuucuuuagugugcuccaggacaugagaaauacuauuauggccucuaagaccauaggaacauccgaagagaaacuuaggaagaaaagcucguucuaccagucuuaucugcggcgaacccaauccaugggcauccaguuggaucagcgcauuaucguccuauuuaugguugacugggguaaggaagcaguggacucauuccaccugggggaugacauggauccagagcucagaggacuggcccaggcucuuauagaccaaaagguaaaagaaauuaguaaccaggagccccugaaguuguga

SEQ ID NO: 5615 - RNA, 1290 nt, Artificial Sequence
  derived and/or modified CDS sequence (opt3) from DOBV(Slovakia-862-Aa)__AJ269550.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcuauuugcggcuuguacccugcccaggucaaggcgcgaaaccuggugagcccaguaauguccguuaucggcuuuauggcacuagccaaaaauuggacagaaagaguggaggaauggcucgaccugcccuguaaacuucugucagagccuaguccaaccagcuugacgaaggggccgucuacuaacagggauuaucucaaucagcggcagggagcucuggccaagauggaaaccaaggaggcacaagcuguccguaaacacgccauagacgcggguugcaacauuaucgaucauauugacucccccucaagcaucuggguguucgccggccgcccugauagauguccacccacaugcuuauuuaucgcagggauggcugagcugggagccuucuuuagugugcuccaggacaugaggaauacuauuauggcuucuaagaccauaggcacauccgaagagaaacuucggaagaaaagcucguucuaccagucuuaucugcgacgcacccaauccauggguauccaguuggaucagagaauuaucguccuauuuaugguugacugggggaaggaagccguggacucauuccaccugggagaugacauggauccugagcucaggggccuggcacaggcccuuauagaccaaaagguaaaagaaauuaguaaccaggagccacugaaguuguga

SEQ ID NO: 5616 - RNA, 1290 nt, Artificial Sequence
  derived and/or modified CDS sequence (opt3) from DOBV(Esl/29Aa/01)__AY533118.2__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcuauuugcggcuuguacccugcccaggucaaggcgcgaaaccuggugagcccaguaauguccguuaucggcuuucuagcacucgccaaaaauuggacagaaagaguggaggaauggcuggaccuucccuguaagcuguugucagagccuaguccaaccagccucacgaaagggccgucuacuaacagggauuaucugaaucagcggcagggagcuuuagccaagauggaaaccaaggaggcacaagcuguccguaaacacgccauagacgcggguugcaacauuaucgaucauauugacucccccucaagcaucuggguguucgccggcgcaccugaucgcuguccacccacaugccuguuuaucgcugggauggccgagcucggagcuuucuuuagugugcuucaggacaugagaaauacuauuauggccucuaagaccauaggcacauccgaagagaaacugaggaagaaaagcucguucuaccagucuuauuugcggcgaacccaauccauggguauccagcuagaucagcgcauuaucguccuguuuaugguugacugggggaaggaagcaguggacucauuccaccucggagaugacauggauccugagcugagaggccuugcccaggcucugauagaccaaaagguaaaagaaauuaguaaccaggagccauugaagcucuga

SEQ ID NO: 5617 - RNA, 1290 nt, Artificial Sequence
  derived and/or modified CDS sequence (opt3) from DOBV(Kurkino/44Aa/98)__AJ131672.1__N
auggccacccuggaggaacuccagaaggagaucaacagccacgaaggccaacuugugauugcuagacagaaagucaaggacgcagagaaacagcaugaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaccucaaggagaaaagcaugcuguccuacgggaauguaaucgaccuuaaccaucuggauauugacgaaccgacuggacagacggccgauugguugucuaucguggucuaucucaccucguucgugguucccauacugcugaaggcucucuacauguuaacaacuaggggccggcagaccacaaaagacaauaaggguaugcgcaucagauuuaaggacgauagcucauucgaggacgugaacgggauuaggaaaccuaagcaccuguuucuuaguaugccaaaugcacaauccucuaugaaagccgaugagaucacccccggacgguuccgcacugcuauuugcggcuuguauccugcccaggucaaggcgcgaaaccuggugagcccaguaauguccguuaucggcuuucuagcacucgccaaaaauuggacagaaagaguggaggaauggcuggaccuucccuguaagcuguugucagagccuaguccaaccagccucacgaaagggccgucuacuaacagggauuaccugaaucagcggcaggcugccuuagcaaagauggaaaccaaggaggcucaagccguccguaaacaugcgauagacgccggaugcacaauuaucgauuauauugacucccccucaagcaucuggguguucgcuggugcaccugaucgcuguccacccacuugccuguuuaucgccggcauggcugagcucggggccuucuuuagugugcuucaggacaugagaaacaccauuauggcaucuaagacagucggaaccuccgaagagaaacugaggaagaaaagcucguucuaccagucuuauuugcggcgaacgcaauccaugggcauacagcuagaucagcgcaucauuguucuguuuaugguggacugggguaaggaagccguagacucauuccaccucggggaugacauggauccugagcugagaggacuugcucaggcgcugaucgaccaaaaggugaaagaaauaaguaauagggagccauugaagcucuga

SEQ ID NO: 5618 - RNA, 1290 nt, Artificial Sequence
  derived and/or modified CDS sequence (opt3) from DOBV(Kurkino/53Aa/98)__AJ131673.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcuauuugcggcuuguacccugcccaggucaaggcgcgaaaccuggugagcccaguaauguccguuaucggcuuucuagcacucgccaaaaauuggacagaaagaguggaggaauggcuggaccuucccuguaagcuguugucagagccuaguccaaccagccucacgaaagggccgucuacuaacagggauuaucugaaucagcggcaggcugccuuagcaaagauggaaaccaaggaggcucaagccguccguaaacacgcgauagacgccggaugcacaauuaucgaucauauugacucccccucaagcaucuggguguucgcuggugcaccugaucgcuguccacccacuugccuguuuaucgccggcauggcugagcucggggccuucuuuagugugcuucaggacaugagaaacaccauuauggcaucuaagacagucggaaccuccgaagagaaacugaggaagaaaagcucguucuaccagucuuauuugcggcgaacgcaauccaugggcauacagcuagaucagcgcaucauuguucuguuuaugguggacugggguaaggaagccguagacucauuccaccucggggaugacauggauccugagcugagaggacuugcucaggcgcugaucgaccaaaaggugaaagaaauaaguaauagggagccauugaagcucuga

SEQ ID NO: 5619 - RNA, 1290 nt, Artificial Sequence
  derived and/or modified CDS sequence (opt3) from DOBV(Saar/90Aa/97)__AJ009775.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuauagcgcagucaauccaagggaagauugaugaguuacgccgacagcuggcugaccguguugccgcaggaaagaacaucgguagagaaagggauccuacaggccuagacccaggggaucaucucaaagagaagaguaugcugagcuauggaaaugugauugaccuuaaccaccuggauaucgacgaaccgacuggccagacggccgauugguuguccauaguaaucuaccucaccucuuucgugguccccauucugcugaaagcucucuauauguuaacaacucggggucgccagaccacaaaggacaauaaagggaugagaaucagguuuaaggacgauucgucauucgaggacgugaacggcauucggaagccuaaacaucuguuucuuagcaugccaaaugcacaaaguuccaugaaggccgaugagaucacccccggacgcuuccgaacugcuguuugcggcuuguacccugcccaggugaaagcgagaaaccugauaucuccagucaugagcgugauuggguuucuaacacucgcaaagaauuggaccgaaaggguagaggaauggcuggaccuucccuguaaacuguuguccgagccuucaccaacgagucucacuaagggaccgagcaccaaccgggauuaucugucucagcgucagggugccuuagcuaaaauggaaacaaaggaggcccaagcaguucgcaagcacgcuaucgacgccggcugcaauauuaucgaucauaucgacucccccucaagcauuuggguguucgcgggggccccugauagauguccacccacuugccuguuuauagcaggaauggcugagcucggcgccuucuuugcuguccuucaggacaugaggaacaccaucauggccaguaaaacaauugguaccucugaagagaagcugcggaaaaaguccagcuucuaccagucguauuugcgacgcacgcaaucuauggggauccagcuagaucagagaauaauugugcuguuuaugaucgaauggggaaaagaggcaguggacuccuuccaccucggcgacgauauggacccugaaaucaggucacuggcccaggcucuuauugaucaaaaggucaaggagaucaguaaucaggagccacugaaauuguga

SEQ ID NO: 5620 - RNA, 1290 nt, Artificial Sequence
  derived and/or modified CDS sequence (opt3) from DOBV(SK/Aa)__AY961615.1__N
auggccacccuggaggaacuccagaaggagaucaacagccacgaaggccaacuugugauugcuagacagaaagucaaggacgcagagaaacaguacgaaaaggaucccgacgaucugaauaaaaggacauuguccgaccgggagucuguugcccagucaauacaaaguaagaucgaugaguuacgccgacagcuggcggaccguguggcugccgggaagaacauuggaaaagaaagagauccuacuggucuagacccaggcgaucaucucaaggagaaaagcaugcuguccuaugggaauguaaucgaccuuaaccaccuggauauugacgaaccgacgggacagaccgcagauugguugucuaucguggucuaccucacaucguucgugguucccauacugcugaaggcccucuauauguuaacuaccaggggccggcagacaaccaaagacaauaaggguaugcgcaucagauuuaaggacgauagcucauucgaggacgugaacgggauuaggaaaccuaagcaucuguuucuuaguaugccaaaugcucaauccucuaugaaagcagaugagaucacucccggacgguuccgcacagccauuugcggcuuguacccugcucaggucaaggcccgaaaccuggugagcccaguaauguccguuaucggcuuucuagcgcucgccaaaaauuggaccgaaagaguggaggaauggcuggaccuucccuguaagcuguugucagagccuaguccaacgagccucacuaaagggccgucuaccaacagggauuaucugaaucagcggcagggagcauuagcuaagauggaaacaaaggaggcccaagcaguccguaaacacgcuauagacgccgguugcaacauuaucgaucauauugacucccccucaagcaucuggguguucgcgggcgccccugaucgcuguccacccacuugccuguuuaucgcagggauggcugagcucggagccuucuuuagugugcuucaggacaugagaaauaccauuauggcuucuaagacaauaggcaccuccgaagagaaacugaggaagaaaagcucguucuaccagucuuauuugcggcgaacgcaauccauggguauccagcuagaucagcgcauuaucguccuguuuaugguugacugggggaaggaagccguggacucauuccaccucggagaugacauggauccugagcugagaggccuugcacaggcccugauagaccaaaagguaaaagaaauuaguaaccaggagccauugaagcucuga

SEQ ID NO: 5621 - RNA, 1290 nt, Artificial Sequence
  derived and/or modified CDS sequence (opt3) from DOBV(A35)__GU904030.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaaucuaccucaccuccuucgugguccccauucugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcuauaugcggcuuguacccugcccagguuaaggcgcgaaaucugauuuccccagugaugucugucaucggguuuguggcacuagccaaaaacuggacagaaagaguagaggaauggcucgaccugcccuguaaacuucugagcgagccuuccccaaccucauugacgaagggaccgaguacuaauagggauuaucucaaccagcggcagggugcucuggccaagauggaaaccaaggaggcacaagcuguucguaaacacgccauugacgcgggcugcaauuuaaucgaucauaucgacagccccucuuccauuuggguguucgccggggcaccugaucgcuguccacccacaugccuguuuauagcuggaauggccgagcucggcgcuuucuuugccguccuucaggacaugagaaacacuaucauggcaucaaagaccauugguacaagcgaagagaaacugaagaaaaagaguucuuucuaccaguccuauuugaggcggacccaaagcauggggauccagcuagaucagcgaauaauugugcuguuuaugguggacuggggaaaggaagccgucgacucguuccaccucggcgaugacauggauccugagcugcgcggccuugcucaggcgcugaucgaccaaaaaguuaaggaaaucucuaaucaggagccauugaaacucuga

SEQ ID NO: 5622 - RNA, 1290 nt, Artificial Sequence
  derived and/or modified CDS sequence (opt3) from DOBV(3970/87)__L41916.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaaucuaccucaccuccuucgugguccccauucugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcuauaugcggcuuguacccugcccagguuaaggcgcgaaaucugauuuccccagugaugucugucaucggguuuguggcacuagccaaaaacuggacagaaagaguagaggaauggcucgaccugcccuguaaacuucugagcgagccuuccccaaccucauugacgaagggaccgaguacuaauagggauuaucucaaccagcggcagggugcucuggccaagauggaaaccaaggaggcacaagcuguucguaaacacgccauugacgcgggcugcaauuuaaucgaucauaucgacagccccucuuccauuuggguguucgccggggcaccugaucgcuguccacccacaugccuguuuauagcuggaauggccgagcucggcgcuuucuuugccugucuucaggacaugagaaacacuaucauggcaucaaagaccauugguacaagcgaagagaaacugaagaaaaagaguucuuucuaccaguccuauuugaggcggacccaaagcauggggauccagcuagaucagcgaauaauuguccuguuuaugguggacuggggaaaggaagccguggacucguuccaccucggcgaugacauggauccugagcugcgcggccuugcucaggcgcugaucgaccaaaaagucaaggaaaucucuaaucaggagccauugaaacucuga

SEQ ID NO: 5623 - RNA, 1290 nt, Artificial Sequence
  derived and/or modified CDS sequence (opt3) from DOBV(Klyuch-2000)__AF442622.1__N
auggccacccuggaggaacuccagaaggagaucaacagccacgaaggccaacuugugauugcuagaaggaaagucaaggacgcagagaaacaguacgaaaaggaucccgacgaucugaauaaacgggccuuguccgaccgcgagucuguugcgcagucaauacaggggaagaucgaugaguuacgacgucaacuggcugacagaguggccgcaggaaagaacauugguaaagaaagggauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacucggggucgccagaccacaaaagacaauaaggggaugagaaucagguuuaaggacgauucgucauucgaggacgugaacggcauucggaaaccuaagcaucuguuucuuagcaugccaaaugcacagaguuccaugaaagccgaugagaucacccccggacgcuuccgaacugcugucugcggcuuguacccugcccaagugaaggcgagaaaccugguaucuccaguuaugagcgugauuggguuugucucccuagcaaagaauuggacagaaaggguggaggaauggcucgaccugcccuguaaacuucugucagagccuaguccaaccagcuugacgaaaggaccgucuacuaaccgggauuaucucaaucagcgucagggugcccuggcuaagauggaaaccaaggaggcccaggcagugcgcaaacacgcuaucaacgccggcugcaauuuagucgaccauauagauucccccucaagcauuuggguuuucgcgggggccccugacagauguccacccacaugccuguuuguggcaggaauggcugagcucggcgccuucuuugcuguacuucaagauaugaggaacacuaucauggccaguaagaccauugguacaucugaagagaaacugcggaagaaauccagcuucuaccagucguauuugcgacgcacccagucuauggggauccaacuagaccagagaaucauugugcuguuuauggucgauuggggaaaggaagcaguggacuccuuccaccucggcgacgauauggacccugagcugaggggccuugcccaggcucugauagaacagaagguuaaagagaucucaaaucaagagccauugaagcucuga

SEQ ID NO: 5624 - RNA, 1290 nt, Artificial Sequence
  derived and/or modified CDS sequence (opt3) from DOBV(10636/Ap)__KP878311.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccguugcgcagucuauacaagggaagaucgaugaguuacgccgacagcuggcugaccguguggccgcaggaaagaauauugguaaagaaagagauccuacaggccuagacccaggggaucaucucaaggagaaaucaaugcugaguuauggaaacguaaucgaccuuaaucaccuggauauugacgaaccgacuggccagacggccgauugguugagcaucguggucuaccucaccuccuucgugguucccauacugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcugucugcggcuuguacccugcccaggugaaggcgcgaaaucugguauccccaguuaugucugugauuggguuugucagccuagcaaagaacuggacagaaagaguggaggaauggcucgaccugcccuguaaacuucuguccgagccuucaccaaccaguuugacgaaaggaccgagcacuaauagggauuaucucaaccagcggcagggugcccuggcuaagauggaaaccaaggaggcccaagcagugcguaaacacgcuaucgacgccggcugcaauuuagucgaucauauagacucucccuccucaauuuggguuuucgcgggggccccugaucgcuguccacccacaugccuguuuguggcaggaauggcugagcucggcgccuucuuugcuguacuucaggacaugagaaacacuaucauggccagcaagaccauugguacaagugaagagaaacugaggaagaaaucuuccuucuaccagagcuauuugcggcgaacccaaucgauggggauccagcuagaucagcgcaucauugugcuguuuauggucgacuggggaaaggaagcaguggacucuuuccaccucggcgaugacauggauccugagcugagaucccuugcccaggcucugauagaccaaaagguuaaagaaaucucaaaucaggagccauugaagcucuga

SEQ ID NO: 5625 - RNA, 1290 nt, Artificial Sequence
  derived and/or modified CDS sequence (opt3) from DOBV(10645/Ap)__KP878312.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccguugcgcagucuauacaagggaagaucgaugaguuacgccgacagcuggcugaccguguggccgcaggaaagaauauugguaaagaaagagauccuacaggccuagacccaggggaucaucucaaggagaaaucaaugcugaguuauggaaacguaaucgaccuuaaucaccuggauauugacgaaccgacuggccagacggccgauugguugagcaucguggucuaccucaccuccuucgugguucccauacugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcugucugcggcuuguacccugcccaggugaaggcgcgaaaucugguauccccaguuaugucugugauuggguuugucagccuagcaaagaacuggacagaaagaguggaggaauggcucgaccugcccuguaaacuucuguccgagccuucaccaaccaguuugacgaaaggaccgagcacuaauagggauuaucucaaccagcggcagggugcccuggcuaagauggaaaccaaggaggcccaagcagugcguaaacacgcuaucgacgccggcugcaauuuagucgaucauauagacucucccuccucaauuuggguuuucgcgggggccccugaucgcuguccacccacaugccuguuuguggcaggaauggcugagcucggcgccuucuuugcuguacuucaggacaugagaaacacuaucauggccagcaagaccauugguacaagugaagagaaacugaggaagaaaucuuccuucuaccagagcuauuugcggcgaacccaaucgauggggauccagcuagaucagcgcaucauugugcuguuuauggucgacuggggaaaggaagcaguggacucuuuccaccucggcgaugacauggauccugagcugagaggccuugcccaggcucugauagaccaaaagguuaaagaaaucuccaaucaggagccauugaagcucuga

SEQ ID NO: 5626 - RNA, 1290 nt, Artificial Sequence
  derived and/or modified CDS sequence (opt3) from DOBV(Aa1854/Lipetsk-02)__EU188452.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcuauuugcggcuuguacccugcccaggucaaggcgcgaaaccuggugagcccaguaauguccguuaucggcuuucuagcacucgccaaaaauuggacagaaagaguggaggaauggcuggaccuucccuguaagcuguugucagagccuaguccaaccagccucacgaaagggccgucuacuaacagggauuaucugaaucagcggcaggcugccuuagcaaagauggaaaccaaggaggcucaagccguccguaaacacgcgauagacgccggaugcacaauuaucgaucauauugacucccccucaagcaucuggguguucgcuggugcaccugaucgcuguccacccacuugccuguuuaucgccggcauggcugagcucggggccuucuuuagugugcuucaggacaugagaaacaccauuauggcaucuaagccugucggaacauccgaagagaaacugaggaagaaaagcucguucuaccagucuuauuugcggcgaacccaauccaugggcauacagcuagaucagcgcaucauuguucuguuuaugguggacugggguaaggaagccguagacucauuccaccucggggaugacauggauccagagcugagaggacuugcucaggcgcugaucgaccaaaaggugaaagaaauaaguaaucaggagcccuugaagcucuga

SEQ ID NO: 5627 - RNA, 1290 nt, Artificial Sequence
  derived and/or modified CDS sequence (opt3) from DOBV(Ap/Sochi/43)__JF920151.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccguugcgcagucuauacaagggaagaucgaugaguuacgccgacagcuggcugaccguguggccgcaggaaagaauauugguaaagaaagagauccuacaggccuagacccaggggaucaucucaaggagaaaucaaugcugaguuauggaaacguaaucgaccuuaaucaccuggauauugacgaaccgacuggccagacggccgauugguugagcaucguggucuaccucaccuccuucgugguucccauacugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcugucugcggcuuguacccugcccaggugaaggcgcgaaaucugguauccccaguuaugucugugauuggguuugucagccuagcaaagaacuggacagaaagaguggaggaauggcucgaccugcccuguaaacuucuguccgagccuucaccaaccaguuugacgaaaggaccgagcacuaauagggauuaucucaaccagcggcagggugcccuggcuaagauggaaaccaaggaggcccaagcagugcguaaacacgcuaucgacgccggcugcaauuuagucgaucauauagacucucccuccucaauuuggguuuucgcgggggccccugaucgcuguccacccacaugccuguuuguggcaggaauggcugagcucggcgccuucuuugcuguacuucaggacaugagaaacacuaucauggccagcaagaccauugguacaagugaagagaaacugaggaagaaaucuuccuucuaccagagcuauuugcggcgaacccacucgauggggauccaacuagaucagcgcaucauugugcuguuuauggucgacuggggaaaggaagcaguggacucuuuccaccucggcgaugacauggauccugagcugagaggccuugcccaggcucugauagaccagaagguuaaagaaaucuccaaucaagagccauugaagcucuga

SEQ ID NO: 5628 - RNA, 1290 nt, Artificial Sequence
  derived and/or modified CDS sequence (opt3) from DOBV(Ap/Sochi/hu)__JF920150.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccguugcgcagucuauacaagggaagaucgaugaguuacgccgacagcuggcugaccguguggccgcaggaaagaauauugguaaagaaagagauccuacaggccuagacccaggggaucaucucaaggagaaaucaaugcugaguuauggaaacguaaucgaccuuaaucaccuggauauugacgaaccgacuggccagacggccgauugguugagcaucguggucuaccucaccuccuucgugguucccauacugcugaaggcucucuauauguuaacaacuaggggucggcagaccacaaaagacaacaaggggaugcgcaucagauuuaaggacgauucuucguucgaggacgugaauggaauuaggaaaccuaagcaucuguuucuuucaaugccaaacgcacaaagcaguaugaaagccgaugagaucacccccggccgguuccgcacugcugucugcggcuuguacccugcccaggugaaggcgcgaaaucugguauccccaguuaugucugugauuggguuucuaagccucgccaaaaacuggacagaaagagucgaggaauggcuggaccuucccuguaagcuguuguccgagccuucaccaaccagucucacgaaaggaccgagcacuaauagggauuaucugaaccagcggcagggugcauuagcuaagauggaaaccaaggaggcccaagcagugcguaaacacgcuaucgacgccggcugcaaucugguggaucauauagacucucccuccucaauuugggucuucgcgggggccccugaucgcuguccacccacaugccucuuuguugcaggaauggcugagcuuggcgccuucuuugcugugcugcaggacaugagaaacacuaucauggccagcaagaccauugguacaagugaagagaaauugaggaagaaaucuuccuucuaccagagcuaucuacggcgaacccacucgauggggauccaacuggaucagcgcaucauuguacucuuuaugguggacuggggaaaggaagcagucgacucuuuccaccugggcgaugacauggauccugagcuuagaggccuggcccaggcuuugauagaccagaaggugaaagaaaucuccaaucaagagccacucaagcuguga

SEQ ID NO: 5629 - RNA, 1290 nt, Artificial Sequence
  derived and/or modified CDS sequence (opt3) from DOBV(Ap1584/Sochi-01)__EU188449.1__N
auggccacccuggaggaacucaagaaagagaucaacaaucacgaaggccagcuugugauugcuagacaaaaggucaaagacgcagagaagcaguacgaaaaagaucccgacgaucugaacaagagggccuugagcgaccgggaguccguugcgcagucuauacaggggaagaucgaugaguuacgccgacaacuggcugaccguguggccgcagguaaaaauauuggaaaggaaagagauccuacaggccuagacccaggggaucaucucaaagagaagucaaugcugaguuauggaaacguaaucgaccuuaaucaccuggauauugacgaaccgacuggccagacggccgauugguugagcaucguggucuaccucaccuccuucgugguucccauacugcugaaagcucucuauauguuaacaacuaggggucggcagaccacaaaggacaacaaggggaugcgcaucagauuuaaagacgauucuucguucgaggacgugaauggaauuaggaagccuaaacaucuguuucuuucaaugccaaacgcacagagcaguaugaaggccgaugagaucacccccggccgguuccgcacugcugucugcggcuuguacccugcccaagugaaagcgcgaaaucugguauccccaguuaugucugugauuggguuugucagccuagcaaagaacuggacagaaagaguggaggaauggcucgaccugcccuguaaacuucuguccgagccuucaccaaccaguuugacgaagggaccgagcacuaauagggauuaucucaaccagcggcagggugcccuggcuaagauggaaaccaaagaggcccaggcagugcguaagcacgcuaucgacgccggcugcaauuuagucgaucauauagacucucccuccucaauuuggguuuucgcgggggccccugaucgcuguccacccacaugccuguuuguggcaggaauggcugagcucggcgccuucuuugcuguacuucaagacaugagaaacacuaucauggccagcaaaaccauugguacaagugaagagaagcugaggaaaaagucuuccuucuaccagagcuauuugcggcgaacccagucgauggggauccaacuagaucagcgcaucauugugcuguuuauggucgacuggggaaaggaagcaguggacucuuuccaccucggcgaugacauggauccugagcugagaggccuugcccaggcucugauagaccagaaaguuaaggaaaucuccaaucaagagccauugaaacucuga

SEQ ID NO: 5630 - RNA, 1290 nt, Artificial Sequence
  derived and/or modified CDS sequence (opt3) from DOBV(DOB/Gola/235Af/07)__KC848495.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcagucggaaagccgaugagauuacccccggccgcuuccgaacugcuaucugcggcuuguacccugcccaggugaaggcgagaaaucugauauccccagucaugucugugauuggguuucuagcacucgccaaaaacuggacagaaaggguagaggaauggcuggaccuucccuguaagcuguugagcgagccuuccccaaccucacucacgaaaggaccgaguacuaaucgggauuaucugaaccagcgucagggugcuuuagccaagauggaaaccaaggaggcacaagcuguucgcaaacacgccaucgacgcgggcugcaaucugauugaucauaucgacagccccucuuccaucuggguguucgccggggcaccugauagauguccacccacaugccucuuuauugcuggaauggccgagcuuggcgcuuucuuugccguccugcaggacaugaggaacacuauaauggcaucaaagaccaucgguacaagcgaagagaaauugaagaaaaagaguucuuucuaccaguccuaucuacggcgaacccaaagcauggggauucagcuggaucagcgcaucauagugcucuuuaugguggacuggggaaaggaagccgucgacucguuccaccugggcgaugacauggauccugagcuuagaggccuggcucaggcguugauugaccaaaaaguuaaggaaaucucuaaucaggagccacucaaacuguga

SEQ ID NO: 5631 - RNA, 1290 nt, Artificial Sequence
  derived and/or modified CDS sequence (opt3) from DOBV(DOB/Gola/343Af/07)__KC848498.1__N
auggccacccuggaggaacuccagaaggagaucaacaaucacgaaggccaacuugugauugcuagacagaaagucaaggacgcagagaaacaguacgaaaaggaucccgacgaucugaacaaaagggccuugagcgaccgggaguccauagcgcagucuauccaagggaagauugaugaguuacgccgacagcuggcugaccguguugccgcaggaaagaauaucgguaaagaaagagauccuacaggccuagacccaggggaucaucucaaggagaaaucaaugcugaguuauggaaacgugauugaccuuaaucaccuggauaucgacgaaccgacuggccagacggccgauugguugagcauaguaguguaccucaccuccuucgucgugcccauccugcugaaggcucucuauauguuaacaacuaggggucggcagaccacaaaagacaacaaggggaugcgcauuagauuuaaggacgauucuucguucgaggacguuaauggaaucaggaaaccuaagcaucuguuucuuucaaugccaaacgcacaaagcaguaugaaagccgaugagauuacccccggccgguuccgcacugcuaucugcggcuuguacccugcccaggugaaggcgcgaaaucugauauccccagucaugucugugauuggguuucuagcacucgccaaaaacuggacagaaagaguagaggaauggcuggaccuucccuguaagcuguugagcgagccuuccccaaccucacucacgaaaggaccgaguacuaauagggauuaucugaaccagcggcagggugcuuuagccaagauggaaaccaaggaggcacaagcuguucguaaacacgccacagacgcgggcugcaaucugaucgaucauauugacagccccucuuccaucuggguguucgccggggcaccugaucgcuguccacccacuugccucuuuaucgcuggaauggccgagcuuggcgcuuucuuugccguccugcaggacaugagaaacaccauuauggcaucaaagacaauagguaccagcgaagagaaauugaagaaaaagaguucuuucuaccaguccuaucuaaggcggacgcaaagcauggggauccagcuggaucagcgaauuaucgugcucuuuaugguggacuggggaaaggaagccgucgacucguuccaccugggcgaugacauggauccugagcuucgcggccuggcucaggcguugauagaccaaaaaguuaaggaaauuucuaaucaggagccacucaaacuguga

SEQ ID NO: 5632 - RNA, 1290 nt, Artificial Sequence
  derived and/or modified CDS sequence (opt3) from DOBV(DOB/Pecs/27Aa/06)__KC848499.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcgugagauuuaaggacgauagcucauucgaggacgucaacgggaucaggaaaccuaagcaucuguuucuuaguaugccaaaugcacaauccucuaugaaagccgaugagauuacccccggacgguuccgcacugcugugugcggcuuguacccugcccagguaaaggcgcgaaaccugguuagcccagugauguccgucaucggcuuucuagcacucgccaaaaauuggacagaaagaguggaggaauggcuggaccuucccuguaagcuguugucagagccuaguccaaccagccucacgaaagggccgucuacuaacagggauuaucugaaucagcggcagggagcuuuagccaagauggaaaccaaggaggcacaagcugugcguaaacacgccauugacgcggguugcaacaucauagaucauauugacucccccucaagcaucugggucuucgccggcgcaccugaucgcuguccacccacaugccuguuuauugcugggauggccgagcucggagcuuucuuuaguguucuucaggacaugagaaauacuaucauggccucuaagaccaucggcacauccgaagagaaacugaggaagaaaagcucguucuaccagucuuauuugcggcgaacccaauccauggguauucagcuagaucagcgcauaaucgugcuguuuaugguagacugggggaaggaagcaguggacucauuccaccucggagaugacauggauccugagcugagaggccuugcccaggcucugauugaccaaaaggucaaagaaaucaguaaccaggagccauugaagcucuga

SEQ ID NO: 5633 - RNA, 1290 nt, Artificial Sequence
  derived and/or modified CDS sequence (opt3) from DOBV(DOB/Pecs/31Aa/06)__KC848500.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccgcagggaagaacauuggaaaagaaagagauccuacaggucuagacccaggcgaucaucucaaggagaaaagcaugcuguccuaugggaauguaaucgaccuuaaccaccuggauauugacgaaccgacuggacagacggccgauugguugucuaucguggucuaccucaccucguucgugguucccauacugcugaaggcucucuauauguuaacaacuaggggccggcagaccacaaaagacaauaaggguaugcgcaucagauuuaaggacgauagcucauucgaggacgugaacgggauuaggaaaccuaagcaucuguuucuuaguaugccaaaugcacaauccucuaugaaagccgaugagaucacccccggacgguuccgcacugcugucugcggcuuguacccugcccaggugaaggcgcgaaaccugguaagcccaguuauguccgugauuggcuuucuagcacucgccaaaaauuggacagaaagagucgaggaauggcuggaccuucccuguaagcuguugucagagccuaguccaaccagccucacgaaagggccgucuacuaacagggauuaucugaaucagcggcagggagcuuuagccaagauggaaaccaaggaggcacaagcugugcguaaacacgccaucgacgcggguugcaacauaauugaucauaucgacucccccucaagcauuuggguguucgccggcgcaccugaucgcuguccacccacaugccuguuuaucgcugggauggcccagcucggagcuuucuuuaguguccuucaggacaugagaaauacuaucauggccucuaagaccauuggcacauccgaggaaaaacugaggaagaaaagcucguucuaccaaucuuauuugcggcgaacccaguccauggguauacagcuagaucagcgcaucauuguucuguuuaugguggacugggggaaggaggcaguagacucauuccaccucggagaugacauggauccugaacugagaggccuugcccaagcucugaucgaccagaagaugaaagagauaaguaaccaggaaccauugaagcucuga

SEQ ID NO: 5634 - RNA, 1290 nt, Artificial Sequence
  derived and/or modified CDS sequence (opt3) from DOBV(DOB/Sarmellek/77Aa/06)__KC848501.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaaaguaagaucgaugaguuacgccgacagcuggcugaccguguggccagcgggaagaacauuggaaaagaaagagauccuacaggucuagacccaggcgaucaucucacugagaaguccaugcugucuuaugggaauguaaucgaccuuaaccaccuggauauugacgaaccgacgggacagaccgcagauugguugucgaucguggucuaccucacaucauucgugguucccauacugcugaaagcccucuauauguuaacuaccaggggccggcagacaaccaaggacaauaaagguaugcgcaucagauuuaaggacgauagcaguuucgaggacgugaacgggauuaggaagccuaaacaucuguuucuuuccaugccaaaugcucaaucuagcaugaaggcagaugagaucacucccggacgguuccgcacagccauuugcggcuuguacccugcucaggucaaagcccgaaaccugguguccccaguaaugucaguuaucggcuuucuagcgcucgcaaagaauuggaccgaaagaguggaggaauggcuggaccuucccuguaaacuguugagugagccuagcccaacgucucucacuaaggggccguccaccaacagggauuaucugaaucagcggcagggagccuuagcuaaaauggaaacaaaggaggcccaagcaguccguaagcacgcuauagacgccgguugcaacauuaucgaucauauugacucacccagcaguaucuggguguucgcgggcgccccugaucgcuguccacccacuugccuguuuaucgcagggauggcugagcucggagccuucuuuucugugcuucaggacaugagaaauaccauuauggcuuccaaaacagucggcaccagcgaagagaagcugaggaaaaagucgucuuucuaccaguccuauuugcggcgaacgcaaucaauggguauacagcuagaucagcgcaucauuguucuguuuaugguggacugggggaaagaagccguagacaguuuccaccucggagaugacauggauccugagcugagaagccuugcacaggcccugaucgaccaaaaggugaaggaaauauccaaccaggagccauugaaacucuga

SEQ ID NO: 5635 - RNA, 1290 nt, Artificial Sequence
  derived and/or modified CDS sequence (opt3) from DOBV(GER/05/239/Aa)__GQ205405.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuauuugcggcuuguacccugcccaggucaaggcgcgaaaccuggugucuccaguaaugagcguuaucggguuucuagcacucgccaaaaauuggacagaaagaguggaggaauggcuggaccuucccuguaagcuguuguccgagccuucaccaaccagucucacgaaaggaccgagcacuaacagggauuaucugucucagcggcagggugcuuuagccaagauggaaaccaaggaggcacaagcuguccguaaacacgccauagacgcgggcugcaauauuaucgaucauauugacucccccucaagcaucuggguguucgccggggcaccugaucgcuguccacccacaugccuguuuaucgcuggaauggccgagcucggcgcuuucuuugccgugcuucaggacaugagaaacacuauuauggcaaguaagaccauagguacaucugaagagaaacugaggaagaaauccagcuucuaccagucguauuugcggcgaacccaaucuauggggauccagcuagaucagcgcauuaucguccuguuuaugguugacuggggaaaggaagccguggacuccuuccaccucggcgaugacauggauccugagcugagaucacuugcucaggcgcugauagaccaaaagguaaaagaaauuaguaaucaggagccauugaagcucuga

SEQ ID NO: 5636 - RNA, 1290 nt, Artificial Sequence
  derived and/or modified CDS sequence (opt3) from DOBV(GER/05/477/Af)__GQ205406.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuauuugcggcuuguacccugcccaggucaaggcgcgaaaccuggugucuccaguaaugagcguuaucggguuucuagcacucgccaaaaauuggacagaaagaguggaggaauggcuggaccuucccuguaagcugauauccgagccuucaccaaccaguuugacgaaaggaccgagcacuaacagggauuaucucucucagcggcagggugcucuggccaagauggaaaccaaggaggcacaagcuguccguaaacacgccauugacgcgggcugcaauaucauugaucauaucgacucccccucaagcaucuggguguucgccggggcaccugaucgcuguccacccacaugcuuauuuauugcuggaauggccgagcugggcgcuuucuuugccgugcuccaggacaugagaaacacuauaauggcaaguaagaccaucgguacaucugaagagaaacuuaggaagaaauccagcuucuaccagucguaucugcggcgaacccaaucuauggggauucaguuggaucagcgcaucauaguccuauuuaugguugacuggggaaaggaagccguggacuccuuccaccugggcgaugacauggauccugagcucagaucacuggcucaggcgcuuauugaccaaaagguaaaagaaaucaguaaucaggagccacugaaguuguga

SEQ ID NO: 5637 - RNA, 1290 nt, Artificial Sequence
  derived and/or modified CDS sequence (opt3) from DOBV(GER/07/293/Aa)__GQ205401.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuauuugcggcuuguacccugcccaggucaaggcgcgaaaccuggugucuccaguaaugagcguuaucggguuucuagcacucgccaaaaauuggacagaaagaguggaggacuggcuggaucuucccuguaagcuguuguccgaaccuucaccaaccagucucacgaaaggaccgagcacuaacagggacuaucugaaucagcggcagggugcuuuagccaagauggagaccaaggaagcacaagcuguccguaaacacgccauagaugcgggcugcaacauuaucgaccauauugauucucccuccucaaucuggguguucgccggggcaccugaccgcuguccacccacaugccuguuuaucgcuggaauggccgagcucggcgcuuucuuugccgugcuucaggauaugagaaauacuauuauggcaagcaagaccauagguacaagugaggaaaaacugaggaagaaaucuuccuucuaccagagcuauuugcggcgaacccaaucgauggggauccagcuagaccagcgcauuaucguccugcucaugguugacuggggaaaggaggccguggauucuuuucaccugggcgacgauauggacccugaacuuagaggccuggcucaggcguugauagaucaaaagguaaaagagauuuccaaccaggaaccacucaagcuguga

SEQ ID NO: 5638 - RNA, 1290 nt, Artificial Sequence
  derived and/or modified CDS sequence (opt3) from DOBV(GER/07/424/Aa)__GQ205403.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuauuugcggcuuguacccugcccaggucaaggcgcgaaaccuggugucuccaguaaugagcguuaucggguuucuagcacucgccaaaaauuggacagaaagaguggaggacuggcuggaucuucccuguaagcuguuguccgaaccuucaccaaccagucucacgaaaggaccgagcacuaacagggacuaucugaaucagcggcagggugcuuuagccaagauggagaccaaggaagcacaagcuguccguaaacacgccauagaugcgggcugcaacauuaucgaccauauugauucucccuccucaaucuggguguucgccggggcaccugaccgcuguccacccacaugccuguuuaucgcuggaauggccgagcucggcgcuuucuuugccgugcuucaggauaugagaaauacuauuauggcaagcaagaccauagguacaagugaggaaaaacugaggaagaaaucuuccuucuaccagagcuauuugcggcgaacccaaucgauggggauccagcuagaccagcgcauuaucguccuguuuaugguugacuggggaaaggaggccguggauucuuuccaccucggcgacgauauggacccugaacugagaggccuugcucaggcgcugauagaucaaaagguaaaagagauuuccaaccaggaaccauugaagcucuga

SEQ ID NO: 5639 - RNA, 1290 nt, Artificial Sequence
  derived and/or modified CDS sequence (opt3) from DOBV(GER/08/118/Aa)__GQ205407.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcuauuugcggcuuguacccugcccaggucaaggcgcgaaaccuggugucuccaguaaugagcguuaucggguuucuagcacucgccaaaaauuggacagaaagaguggaggacuggcuggaucuucccuguaagcuguuguccgaaccuucaccaaccagucucacgaaaggaccgagcacuaacagggacuaucugaaucagcggcagggugcuuuagccaagauggagaccaaggaagcacaagcuguccguaaacacgccauagaugcgggcugcaacauuaucgaccauauugauucucccuccucaaucuggguguucgccggggcaccugaccgcuguccacccacaugccuguuuaucgcuggaauggccgagcucggcgcuuucuuugccgugcuucaggauaugagaaauacuauuauggcaagcaagaccgucgguacaagugaggagaaaaugaggaagaaaucuuccuucuaccagagcuaucugcggcgaacccaaucgauggggauacaguuggaccagcgcaucauuguucuauuuaugguggacuggggaaaggaagccguagauucuuuccaccugggcgacgauauggacccugaacucagaggccuggcucaggcgcuuaucgaucaaaaggugaaagagauauccaaccaggaaccacugaaguuguga

SEQ ID NO: 5640 - RNA, 1290 nt, Artificial Sequence
  derived and/or modified CDS sequence (opt3) from DOBV(GER/08/131/Af)__GQ205408.1__N
auggccacccuggaggaacuccagaaggagaucaacagccacgaaggccaacuugugauugcuagacagaaagucaaggacgcagagaaacaguacgaaaaggaucccgacgaucugaauaaaagggccuuguccgaccgggagucuguugcgcagucaauacaagggaagaucgaugaguuacgccgacagcuggcugaccguguggccgcaggaaagaacauugguaaagaaagagauccuacaggccuagacccaggggaucaucucaaggagaaaaguaugcugagcuauggaaauguaaucgaccuuaaccaccuggauauugacgaaccgacuggccagacggccgauugguuguccaucguggucuaccucaccucuuucgugguucccauacugcugaaggcucucuauauguuaacaacuaggggucggcagaccacaaaagacaauaaggggaugcgcaucagauuuaaggacgauucgucauucgaggacgugaacggaauuaggaaaccuaagcaucuguuucuuagcaugccaaaugcacaaaguuccaugaaagccgaugagaucacccccggccgguuccgcacugcugucugcggcuuguacccugcccaggugaaggcgcgaaaccugguaucuccaguuaugagcgugauuggguuucuagcacucgccaaaaauuggacagaaagagucgaggacuggcuggaucuucccuguaagcuguuguccgaaccuucaccaaccagucucacgaaaggaccgagcacuaacagggacuaucugaaucagcggcagggugcuuuagccaagauggagaccaaggaagcacaagcugugcguaaacacgccaucgaugcgggcugcaacauaauugaccauaucgauucucccuccucaauuuggguguucgccggggcaccugaccgcuguccacccacaugccuguuuaucgcuggaauggccgagcucggcgcuuucuuugccguccuucaggauaugagaaauacuaucauggcaagcaagaccauugguacaagugaggaaaaacugaggaagaaaucuuccuucuaccagagcuauuugcggcgaacccaaucgauggggauacagcuagaccagcgcaucauuguucuguuuaugguggacuggggaaaggaggccguagauucuuuccaccucggcgacgauauggacccugaacugagaggccuugcucaggcgcugaucgaucaaaaggugaaagagauauccaaccaggaaccauugaagcucuga

SEQ ID NO: 5641 - RNA, 1290 nt, Artificial Sequence
  derived and/or modified CDS sequence (opt3) from HTNV(76-118/POR)__KT885049.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacaaaccgagaggggguugcugugagcauacaggccaagaucgaugaauugaaaaugcaauuagcagaccguauugccacuggaaagaaucuggguaaggagcaggauccuacgggcguagaaccaggggaccaucuaaaagagagauccaugcucucuuauggaaacgugcuggaucuuaaucaccuggacaucgaugagccgaccggccagacagcugacugguugucaauuaucgucuaccucaccaguuucgugguucccauacugcugaaggcacucuauauguuaacuacaaggggucggcagaccacuaaagauaacaaggggacacgcaucagauuuaaagacgauagcuccuucgaagacgugaauggaauuaggaagccuaagcaucuguacgucucucuuccaaacgcccaaucgucaaugaaagcugaggaaaucacccccggccgguaucgcacggccgugugcggcuuguacccugcgcagauuaaggcacgacagaugaucagcccaguaaugaguguuauaggguuucuggcccuagcuaaagacugguccgauagaauugagcaguggcucaucgaacccuguaagcugcuuccugacacugccgcagugucucuguugggagguccagcuaccaauagggauuaucuccggcaacgucaggucgcccugggcaacauggagacaaaagagagcaaggcgauucgccagcacgccgaagcagcugggugcuccaugaucgaggacaucgaaucaccgaguagcauuuggguguucgccggagcucccgauagauguccuccaacuugcuuauuuauagccggcaucgcagagcugggugccuucuuuucuauucuccaagacaugaggaauaccaucauggcuuccaaaacaguggggaccucagaagagaagcugcggaagaaaagcaguuucuaccagucuuaccuucgacgcacgcaguccaugggaauacaguuggaucaaagaauuaucguccuauuuaugguugcguggggcaaggaggcaguggacaacuuccaucugggcgaugacauggaucccgaacucaggacucuggcccagagccuuaucgacguaaaagugaaggagauuucgaaucaggaaccucugaaauuguga

SEQ ID NO: 5642 - RNA, 1290 nt, Artificial Sequence
  derived and/or modified CDS sequence (opt3) from HTNV(A16)__AF288646.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagagggguuggcugccagcauacaggcaaagaucgacgaauuaaaacgucaacuggccgauagaauugcuacuggaaagaaccuagguaaggagcaggacccuacgggcguugaaccaggggaucaucucaaagagagguccaugcugucuuauggaaaugugcuugaccugaaccacuuggauaucgacgagccgaccggccagacagcagauuggcucucaauuguaaucuaccugaccaguuucgugguccccauacugcucaaggccuuauauaugcugacuacacggggucgccagaccacuaaagacaauaaggggacaagaaucagguuuaaagaugacagcuccuucgaagacgugaacggcauucggaagccuaagcaucuuuacguuucuuugccaaaugcucaaucgucaaugaaagccgaggaaaucacccccggacgcuaucgaacggcgauuugcggccuguacccugcacagaucaaggccagacagaugauaagcccagugaugagugucauuggguuucuagcucucgccaaagauugguccgacaggaucgagcaguggcugucugaacccuguaaacuucugccugauacugcagcugugagcuugcacggagguccagccaccaaccgggacuaucuccgucaacgccagguagcgcugggcaauauggagacaaaggaguccaaggccauuagacagcaugcagaaucagcugggugcaguaugguugaggauaucgaaagcccgucuuccaucuggguguucgccggagcucccaacagguguccuccaacuugcuuauuuauugccggcauagcagagcugggugccuucuuuucaauccuccaagacaugcggaauaccauuauggcuagcaaaacagucgggaccagugaagagaaacuucgaaagaagucuuccuucuaccagagcuaccugcgcagaacgcagucgaugggaauccaguuggaucaaaggauaauugugcuauuuaugguggcguggggcaaggaggcagucgacaacuuccaccugggcgaugacauggaucccguucuccggacucuggcccagucucuuaucgacgugaaaguaaaggaaaucuccaaucaggagccucugaaauuguga

SEQ ID NO: 5643 - RNA, 1290 nt, Artificial Sequence
  derived and/or modified CDS sequence (opt3) from HTNV(CA09082007)__HQ834499.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguacgugucucuuccaaaugcucaaucgucaaugaaagccgaggaaaucacccccggacgcuaucgaacggcgauuugcggcuuguacccugcacagaucaaggccagacagaugauaagcccagucaugagugugauuggguuucuggcucuagccaaagauugguccgacaggaucgagcaguggcucucugaacccuguaagcugcuuccugauacugcagcuguaagccugcacggagguccagccaccaaccgggacuauuugcgucaacgccagguugcgcucggcaauauggagacaaaagaguccaaggccauuagacagcaugcagaaucagcugggugcaguaugguggaggauaucgaaagcccgucuuccaucugggucuucgccggagcucccgacagguguccuccaacuugccuguuuauugccggcauagcagaguuaggugccuucuuuucaauccugcaagauaugcggaacaccauuauggcuagcaaaacaguggggaccagugaagagaagcuccgaaagaaaucuuccuucuaccagagcuacauccgcagaacgcagucgaugggaauacagcuugaccaaaggauuaucgugcuguuuauggucgcguggggcaaggaggcaguugauaauuuccacuugggcgacgauauggaccccgaacuacggacucuggcccagucucucaucgaccugaaagugaaggagauuuccaaccaggaaccucuuaaacuguga

SEQ ID NO: 5644 - RNA, 1290 nt, Artificial Sequence
  derived and/or modified CDS sequence (opt3) from HTNV(CA10081109)__HQ834500.1__N
augcccaccagcggcgagcugcagagagaaaucaacgcccacgaggggcaacucgugauugcuaggcagaagguccgggacgcagaaaagcaguacgagaaggauccugacgaacuuaauaaacgcgcccugacagaucgagagggaguugcggcuuccauacaggccaagaucgacgaguugaaacgucaauuagcagauagaauugccacugguaagaaccugggcaaggaacaggacccaacggggguggagccgggagaucaucuaaaagaaaggucuaugcucucauauggcaauguacuggaccuuaaccaccuggauaucgacgagcccaccggucagacagcugauugguugaguauugugaucuaccucacuagcuucgucgugccuauacugcugaaggcacucuauauguuaaccacacgggggcgccagaccacuaaagacaauaagggaacaagaaucagguuuaaagaugacuccucuuucgaggacguuaacggcauucggaagccaaagcaucuguacgugucgcuucccaaugcccaaucaagcaugaaagcugaagagaucaccccuggccgcuaucgaacggccauuugcgaauuguacccagcgcagaucaaggcaaguaaaaugauaucccccgucaugucugugauuggguuucuggcccuagcuaaggauuggagcgacagaaucgagcaguggcucuccgaaccuuguaaacugcuuccagauacugccgcaguaucacugcacggagguccggcuaccaacagggacuauuugcggcagcgucaaguugcccucggcaauauggagacaaaggagaguaaagcgauucgccagcaugccgaaagcgcagggugcucuaugguggaggauaucgaaucccccucaagcaucugggucuucgcuggagccccugacagauguccacccacuugccuguuuauugcuggcauagccgaguuaggugcauucuuuaguauccugcaggauaugaggaacaccauuauggccucuaagacaguggggaccuccgaagagaagcuccggaaaaagagcucguucuaccaaucuuaccuucgacgcacgcaguccaugggaauccagcuggaccagagaauaauuguguuguuuauggucgcuuggggcaaagaggcgguugauaauccucacgcaggcgacgauguggacccaucacuagggaugcuggcccaaagucucaucgacguaaaggugaaagaaaucagcaaccaggagccccugaaacuuuga

SEQ ID NO: 5645 - RNA, 1290 nt, Artificial Sequence
  derived and/or modified CDS sequence (opt3) from HTNV(CA10081113)__HQ834501.1__N
auggccaccagcggcgagcugcagagagaaaucaacgcucacgaggggcaacucgugauugcaaggcagaagguccgggacgccgaaaaacaguacgagaaggaucccgacgaacuuaauaaacgcgcgcugacagaucgagagggaguugcugccuccauacaggcaaagaucgacgaguugaaacgucaauuagccgauagaauugcuacugguaagaaccugggcaaggaacaggacccuacggggguggagccaggagaucaucuaaaagaaaggucuaugcucucauauggcaauguacuggaccuuaaccaccuggauaucgacgagccgaccggucagacagcagauugguugaguauugugaucuaccucacuagcuucgucgugcccauacugcugaaggcccucuauauguuaaccacacgggggcgccagaccacuaaagacaauaagggaacaagaaucagguuuaaagaugacuccucuuucgaggacguuaacggcauucggaagccuaagcaucuguacgugucgcuuccaaaugcucaaucaagcaugaaagccgaagagaucacccccggccgcuaucgaacggcgauuuuugaauuguacccugcacagaucaaggccagacagaugauaaguccagucauguccgugauuggguuccuggcucuagccaaagauuggucugacaggaucgagcaguggcucagcgaacccugcaagcugcuuccugauacugcagcuguaucccugcacggagguccagccaccaaccgggacuauuugcgucaacgccagguugcgcucggcaauauggagacaaaagagucaaaggccauuagacagcaugcagaaagugcuggguguagcaugguggaggauaucgaaucuccguccucaaucugggucuuugccggagcucccgacaggugcccuccaacuugucuguucauugccggcauagcagaguuaggugccuuuuucagcauccugcaagauaugcggaacaccauuauggcuaguaaaacaguggggaccucugaagagaagcuccgaaagaaauccagcuuuuaccagucguaccuucgcagaacgcagucuaugggaauccagcuggaccaaaggauaauuguguuguucauggucgcguggggcaaggaggcaguugauaaucggcaccuaaugaacaucguggaccccgaaccucgcgcccuggcucagucccucaucgauguaaaagugaaggagauuucaaaucaggaaccacugaaacuuuga

SEQ ID NO: 5646 - RNA, 1290 nt, Artificial Sequence
  derived and/or modified CDS sequence (opt3) from HTNV(CA10081203)__HQ834502.1__N
auggccaccaacggcgagcugcagagagaaaucaaugcucacgaggggcaacucgugauugcaaggcagaagguccgggacgccgaaaaacaguacgagaaggaucccgacgaacuuaacaaacgcgcgcugacagaucgagagggaguugcugccagcauacaggcaaagaucgacgaguugaaacgucaauuagccgauagaauugcuacugguaagaaucugggcaaggaacaggacccuacggggguggagccaggagaucaucuaaaagaaagguccaugcucucuuauggcaacguacuggaccuuaaucaccuggauaucgacgagccgaccggucagacagcagauugguugucaauugugaucuaccucaccaguuucgucgugcccauacugcugaaggcccucuauauguuaacuacacgggggcgccagaccacuaaagacaacaagggaacaagaaucagguuuaaagaugacagcuccuucgaggacguuaauggcauucggaagccuaagcaucuguacgugucucuuccaaacgcucaaucgucaaugaaagccgaagagaucacccccggccgcuaucgaacggcgauuuuuggguuguacccugcacagaucaaggccagacagaugauaagcccagucaugagugugauuggauuccuggcucuagccaaagauugguccgacaggaucgaacaguggcucucugagcccugcaagcugcuuccugauacugcagcuguaagccugcacgguggcccagccaccaaucgggacuauuugcgucaacgccagguugcgcucgggaacauggaaacaaaagaguccaaggccauuagacagcaugcagagucagcuggauguaguaugguggaagauaucgagagcccgucuuccaucugggucuuugccggcgcucccgacaggugcccuccaacuugucuguucauugccgguauagcagaauuaggggccuuuuucucaauccugcaagauaugcggaauaccauuauggcuagcaaaacagugggaaccagugaggaaaagcuccgaaagaaaucuuccuuuuaccagagcuaccuucgcagaacgcagucgaugggcauccagcuggaccaaaggauaauuguguuguucauggucgcguggggcaaggaggcaguugaugagcuacacucuggggacggagaacaccaugccucccggacucuggcucagucacucaucgaugugaaaguaaaggagaucaguaaccaggaaccccugaaacuuuga

SEQ ID NO: 5647 - RNA, 1290 nt, Artificial Sequence
  derived and/or modified CDS sequence (opt3) from HTNV(CA10081206)__HQ834503.1__N
auggccaccaucgaggaacugcagagagagauuaacgcucacgaaggccaacucgugauagcaaggcagaagguccgggacgccgagaaacaguacgaaaaggaucccgacgagcuuaauaaacgcgcgcugacagaucgagaggggguugcugccagcauccaggcaaagauugacgaauugaaacgucaauuagccgauagaaucgcuacuggaaagaaccuggguaaggagcaggacccuacgggcguggaaccaggggaucaucuaaaagagagguccaugcucucuuauggaaauguacuggaccuuaaccaccuggauauugacgagccgaccggccagacagcagauugguugucaaucgugauauaccucaccaguuucgucgugcccauccugcugaaggcccucuauauguuaacuacacggggucgccagaccacuaaagacaauaaggggacaagaauuagguuuaaagaugacagcuccuucgaagacguuaacggaauccggaagccuaagcaucuguacgugucucuuccaaaugcucaaucgucaaugaaagccgaggaaauuacccccggccgcuaucgaacggcgaucugcggcuuguacccugcacagauaaaggccagacagaugauuagcccagucaugagugugaucggguuucuggcucuagccaaagauugguccgacaggauugagcaguggcucucugaacccuguaagcugcuuccugauacugcagcuguaagccugcacggagguccagccaccaaccgggacuauuugcgucaacgccagguugcgcucggcaauauggagacaaaagaguccaaggccaucagacagcaugcagaaucagcugggugcaguaugguggaggauaucgaaagcccgucuuccauuugggucuucgccggagcucccgacagguguccuccaacuugccuguuuauagccggcaucgcagaguuaggugccuucuuuucaauucugcaagauaugcggaacaccaucauggcuagcaaaacaguggggaccagugaagagaagcuccgaaagaaaucuuccuucuaccagagcuaccuucgcagaacgcagucgaugggaauacagcuggaccaaaggauuaucguguuguuuauggucgcguggggcaaggaggcaguugauaauuuccacgccugggacggcauggaucccgaacuacggacucuggcucagucucucaucgacgugaaaguaaaggagauuuccaaccaggaaccucugaaacuuuga

SEQ ID NO: 5648 - RNA, 1290 nt, Artificial Sequence
  derived and/or modified CDS sequence (opt3) from HTNV(CA10081708)__HQ834504.1__N
augcccaccagcggcgagcugcagagagaaaucaacgcccacgaggggcaacucgugauugcuaggcagaagguccgggacgcagaaaaacaguacgagaaggauccugacgaacuuaauaaacgcgcccugacagaucgagagggaguugcggcuuccauacaggccaagaucgacgaguugaaacgucaauuagcagauagaauugccacugguaagaaccugggcaaggaacaggacccaacggggguggagccgggagaucaucuaaaagaaaggucuaugcucucauauggcaauguacuggaccuuaaccaccuggauaucgacgagcccaccggucagacagcugauugguugaguauugugaucuaccucacuagcuucgucgugccuauacugcugaaggcacucuauauguuaaccacacgggggcgccagaccacuaaagacaauaagggaacaagaaucagguuuaaagaugacuccucuuucgaggacguuaacggcauucggaagccaaagcaucuguacgugucgcuucccaaugcccaaucaagcaugaaagcugaagagaucaccccuggccgcuaucgaacggccauuuuugaauuguacccagcgcagaucaaggcaagaaaaaugauaagucccgucauguccgugauuggguuccuggcccuagcuaaggauuggucugacaggaucgagcaguggcucagcgaaccuugcaaacugcuuccagauacugccgcaguaucccugcacggagguccggcuaccaaccgggacuauuugcgucagcgccaaguugcccucggcaauauggagacaaaggagucaaaagcgauuagacagcaugccgaaagugcaggguguagcaugguggaggauaucgaaucucccuccucaaucugggucuuugcuggagccccugacaggugcccacccacuugucuguucauugcuggcauagccgaguuaggugcauuuuucagcauccugcaggauaugcggaacaccauuauggccaguaagacaguggggaccucugaagagaagcuccgaaagaaguccagcuuuuaccaaucguaccuucgcagaacgcagucuaugggaauccagcuggaccagaggauaauuguguuguucauggucgcuuggggcaaagaggcgguugauaauccucacacuggcgacgaugcagacccagaacuacggacacuggcccaaucccucaucgacgugaagguaaaagagaucucaaaccaggaaccccugaaacuuuga

SEQ ID NO: 5649 - RNA, 1290 nt, Artificial Sequence
  derived and/or modified CDS sequence (opt3) from HTNV(CA10081905)__HQ834505.1__N
auggccaccagcggcgagcugcagagagaaaucaacgcucacgaggggcaacucgugauugcaaggcagaagguccgggacgccgaaaaacaguacgagaaggaucccgacgaacuuaauaaacgcgcgcugacagaucgagagggaguugcugccuccauacaggcaaagaucgacgaguugaaacgucaauuagccgauagaauugcuacugguaagaaccugggcaaggaacaggacccuacggggguggagccaggagaucaucuaaaagaaaggucuaugcucucauauggcaauguacuggaccuuaaccaccuggauaucgacgagccgaccggucagacagcagauugguugaguauugugaucuaccucacuagcuucgucgugcccauacugcugaaggcccucuauauguuaaccacacgggggcgccagaccacuaaagacaauaagggaacaagaaucagguuuaaagaugacuccucuuucgaggacguuaacggcauucggaagccuaagcaucuguacgugucgcuuccaaaugcucaaucaagcaugaaagccgaagagaucacccccggccgcuaucgaacggcgauuuuugaauuguacccugcacagaucaaggccagaaaaaugauaaguccagucauguccgugauuggguuccuggcucuagccaaggauuggucugacaggaucgagcaguggcucagcgaacccugcaaacugcuuccugauacugcagcuguaucccugcacggagguccagccaccaaccgggacuauuugcgucagcgccaaguugcgcucggcaauauggagacaaaggagucaaaagccauuagacagcaugcagaaagugcuggguguagcaugguggaggauaucgaaucuccguccucaaucugggucuuugccggagcucccgacaggugcccuccaacuugucuguucauugccggcauagcagaguuaggugccuuuuucagcauccugcaggauaugcggaacaccauuauggcuaguaagacaguggggaccucugaagagaagcuccgcaaaaaguccagcuuuuaccaaucguaccuucgaagaacgcagucuaugggaauccagcuggaccagaggauaauuguguuguucauggucgcguggggcaaagaggcaguugauaaucaccaccuaaucaacgccggcgaccaugaacugcggacucucgcucaaucccugaucgaugugaagguaaaagagauuucaaaucaggaaccccuuaagcuguga

SEQ ID NO: 5650 - RNA, 1290 nt, Artificial Sequence
  derived and/or modified CDS sequence (opt3) from HTNV(E142)__AF288644.1__N
auggccaccauggaggaacugcagagagagaucaacgcucacgaaggccaacucgugauugcaaggcagaagguccgggacgccgagaaacgcuacgaaaaggaucccgacgagcuuaauaaacgaacacugacugaucgugaggggguugcggcuagcauacaggccaagaucgacgaauugaaaagacaguuagcagauaggauugccacgggaaagaaccuggguaaggagcaagacccuaccggcguggaaccaggggaucaucuaaaagagcgguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccgcgguagacagacuacaaaagacaauaaggggaccaggauccgguuuaaagaugacagcuccucugaagacguuaacggcauucgcaagccuaagcaucuguacgugucgcuuccaaaugcccagucaagcaugaaagcugaggaaaucacgcccggacgauauagaacugccauuugcggcuuguacccugcgcaaaucaaggcaaggcagaugauaaguccagucauguccgugauuggguuccuggcccuagcuaaagauuggucugaccggaucgagcaguggcucagcgaacccuguaagcugcuuccugauaccgccgcaguaucccugcacggagguccagcuacaaaccgugacuauuugcgccagagacaaguugcccucggcaauauggagacuaaagagucaaaggcgauuaggcagcaugccgaaagugcagggugcagcaugaucgaggauaucgaaucuccguccucaauuuggguguuugcuggagcccccgaccgguguccuccaaccugccuguucauagcuggcaucgccgaguuaggugcauuuuucagcauucugcaggauaugcgaaacacaaucauggccaguaaaaccgucgggacgucugaagagaagcuccgcaagaaauccagcuuuuaccaaucguaccuuagaaggacucagucuaugggaauacagcuggaccagcggauuaucguguuguucaugguggcuuggggcaaggaggucguugauaauuuucaccuaggcgacgauauggaccccgaacugcgcacacucgcgcaaucccugaucgacgugaaaguaaaggagauuucaaaccaggaaccucuuaaacuguga

SEQ ID NO: 5651 - RNA, 1290 nt, Artificial Sequence
  derived and/or modified CDS sequence (opt3) from HTNV(H10150)__HQ834506.1__N
auggccaccaugggcgagcugcagagagaaaucaacgcucacgaggggcaacucgugauugcaaggcagaagguccgggacgccgaaaaacaguacgagaaggaucccgacgaacuuaauaaacgcgcgcugacagaucgagagggaguugcugccagcauacaggcaaagaucgacgaguugaaacgucaauuagccgauagaauugcuacugguaagaaccugggcaaggaacaggacccuacggggguggagccaggagaucaucuaaaagaaagguccaugcucucuuauggcaauguacuggaccuuaaccaccuggauaucgacgagccgaccggucagacagcagauugguugucaauugugaucuaccucaccaguuucgucgugcccauacugcugaaggcccucuauauguuaacuacacgggggcgccagaccacuaaagacaauaagggaacaagaaucagguuuaaagaugacagcuccuucgaggacguuaacggcauucggaagccuaagcaucuguacgugucucuuccaaaugcucaaucgucaaugaaagccgaagagaucacccccggccgcuaucgaacggcgauuuuuggguuguacccugcacagaucaaggccagacagaugauaagcccagucaugagugugauuggauuccuggcucuagccaaagauugguccgacaggaucgaacaguggcucucugagcccugcaagcugcuuccugauacugcagcuguaagccugcacgguggcccagccaccaaccgggacuauuugcgucaacgccagguugcgcucgggaauauggaaacaaaagaguccaaggccauuagacagcaugcagagucagcuggauguaguaugguggaagauaucgagagcccgucuuccaucugggucuuugccggcgcucccgacaggugcccuccaacuugucuguucauugccgguauagcagaauuaggggccuuuuucucaauccugcaagauaugcggaacaccauuauggcuagcaaaacagugggaaccagugaggaaaagcuccgaaagaaaucuuccuuuuaccagagcuaccuucgcagaacgcagucgaugggcauccagcuggaccaaaggauaauuguguuguucauggucgcguggggcaaggaggcaguugauaaucaccacugggccaacgcuaucgggucugagcuacggacucuggcccagucccucaucgacgugaaaguaaaggaaauuucaaaucaggagccccugaaacuuuga

SEQ ID NO: 5652 - RNA, 1290 nt, Artificial Sequence
  derived and/or modified CDS sequence (opt3) from HTNV(Aa03-161)__KT935024.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugaugccgcagcugucagccuguugggagguccagccacuaaccgggacuaucuccgucaacgccagguggcgcugggcaauauggagaccaaagaguccaaggccauuagacagcacgcagaagcugccgggugcucaaugaucgaggauauugaaaguccgagcucuaucuggguguucgcuggagcccccgacagguguccuccaacaugcuuauuuaucgcaggcauugccgagcugggugcuuucuuuuccauacuccaagauaugcggaacacuaucauggcgucaaaaaccgucgggacaagcgaagagaaacuucgaaagaagaguucuuucuaccaguccuaccugcgcagaacccagagcaugggcauucaguuggaccaaaggaucauaguucuauuuaugguggcauggggaaaggaggccguagauaauuuccaucugggcgacgauauggaccccgaacuccggacgcuggcucagucgcuuauugacgugaaagucaaggagaucucuaaccaggaaccucugaaauuguga

SEQ ID NO: 5653 - RNA, 1290 nt, Artificial Sequence
  derived and/or modified CDS sequence (opt3) from HTNV(Aa04-722)__KU207190.1__N
auggccaccauggaggaacugcagagagagaucaacgcucacgaaggccaacucgugauugcaaggcagaagguccgggacgccgagcgccaguacgaaaaagaucccgacgagcuuaauaagcgagcgcugacagaucgugaggggguugcugugagcauacaggccaaaaucgacgaauugaagagacaauuagcagauaggauugccacugguaaaaaccugggaaaggagcaggacccuacgggcguagaaccaggggaucaucuaaaggagcgguccaugcucucuuauggaaaugugcuggaccuuaaccaccuggauaucgacgagccgaccggccagacagcugauugguugucaauugucguguaccucaccaguuucguugugcccauccugcugaaagcacucuauauguuaacuacacgcgguagacagaccacuaaggacaauaaagggacaaggauacgguuuaaggaugacagcuccuucgaagacgucaacggaauccgcaaaccuaagcaucuguacgugucucuuccaaaugcccaaucgucaaugaaggcugaggaaauuacccccggccgauauagaacggccguaugcggcuuguacccugcgcagaucaaagcaaggcagaugauuagcccaguuaugagugugaucggguuucuggcccuagcuaaggauugguccgaccggauagagcaguggcucucugaacccuguaaacugcuuccugauacugccgcagucagccuguugggagguccagcuaccaaccgugacuaucuccgccaaagacagguggcccugggcaauauggagacaaaggaguccaaagcgauuaggcagcacgccgaagcagcugggugcucaaugaucgaggauauugaaaguccgagcucuaucuggguguucgccggagcucccgaccgguguccuccaacuugcuuauuuaucgccggcauugcagagcugggugccuucuuuuccauacuccaagauaugcgaaacaccaucauggcuucaaagacagucgggaccagcgaagagaaacuucgcaagaagaguucuuucuaccaguccuaccugagaaggacgcagagcaugggcauucaguuggaccaacggaucauaguucuauuuaugguggcguggggaaaagaggcaguagauaauuuccaucugggcgacgauauggaccccgaacuccgcacucuggcccagucgcuuauugacgugaaggucaaagagaucucuaaccaggaaccucugaaguuguga

SEQ ID NO: 5654 - RNA, 1290 nt, Artificial Sequence
  derived and/or modified CDS sequence (opt3) from HTNV(Aa05-190)__KT935027.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacugccgcagucagccuguugggagguccagcuaccaaccgggacuaucuccgucaacgccagguggcccugggcaauauggagacaaaagaguccaaggcgauuagacagcacgccgaagcagcugggugcucaaugaucgaggauauugaaaguccgagcucuaucuggguguucgccggagcucccgacagguguccuccaacuugcuuauuuaucgccggcauugcagagcugggugccuucuuuuccauacuccaagauaugcggaacaccaucauggcuucaaaaacagucgggaccagcgaagagaaacuucgaaagaagaguucuuucuaccaguccuaccugcgcagaacgcagagcaugggcauucaguuggaccaaaggaucauaguucuauuuaugguggcguggggaaaggaggcaguagauaauuuccaucugggcgacgauauggaccccgaacuccggacucuggcccagucgcuuauugacgugaaagucaaggagaucucuaaccaggaaccucugaaauuguga

SEQ ID NO: 5655 - RNA, 1290 nt, Artificial Sequence
  derived and/or modified CDS sequence (opt3) from HTNV(Aa10-123)__KT935036.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacuaccgccgucagccuguugggagguccagcaacaaaccgggacuaucuccgucaacgccagguggcucugggcaauauggagacuaaagaguccaaggccauuagacagcacgcggaagccgcagggugcucaaugaucgaggauauugaaaguccgagcucuaucuggguguucgcuggagcccccgacagguguccuccaaccugcuuauuugucgcuggcaucgccgagcugggugcauucuuuuccauucuccaagauaugcggaacacaauaauggccucaaaaaccguugggacgagcgaagagaaacuucgaaagaagaguucuuucuaccaguccuaccugcgcagaacucagagcaugggaauccaguuggaccaaaggauuaucgugcuauuuaugguagcuuggggcaaggaggcgguggauaauuuccaucugggcgacgauauggaccccgaacuccggacacuggcacagucgcuuauagacgucaaagugaaggagauuucuaaccaggaaccucugaaauuguga

SEQ ID NO: 5656 - RNA, 1290 nt, Artificial Sequence
  derived and/or modified CDS sequence (opt3) from HTNV(Aa10-265)__KU207194.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacugccgcagucagccuguugggagguccagcuaccaaccgggacuaucuccgucaacgccagguggcccugggcaauauggagacaaaagaguccaaggcgauuagacagcacgccgaagcagcugggugcucaaugaucgaggauauugaaaguccgagcucuaucuggguguucgccggagcucccgacagguguccuccaacuugcuuauuugucgccggcaucgcagagcugggugccuucuuuuccauucuccaagauaugcggaacaccauaauggcuucaaaaacaguugggaccagcgaagagaaacuucgaaagaagaguucuuucuaccaguccuaccugcgcagaacgcagagcaugggaauccaguuggaccaaaggauuaucgugcuauuuaugguagcguggggcaaggaggcaguggauaauuuccaucugggcgacgauauggaccccgaacuccggacucuggcccagucgcuuauagacgucaaagugaaggagauuucuaaccaggaaccucugaaauuguga

SEQ ID NO: 5657 - RNA, 1290 nt, Artificial Sequence
  derived and/or modified CDS sequence (opt3) from HTNV(AA1028)__AF427318.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccaucugcggcuuguacccugcgcagauuaaggcaagacagaugaucagcccaguaaugaguguuauaggguuucuggcccuagcuaaagauugguccgacaggauugagcaguggcucucugaacccuguaagcugcuuccugauacugccgcagugagccuguugggagguccagcuaccaaccgggacuaucuccgucaacgccaggucgcccugggcaauauggagacaaaagaguccaaggcgaucagacagcacgccgaagcagcugggugcucaaugauugaggauaucgaaaguccgagcucuaucuggguguucgccggagcucccgacagguguccuccaacuugcuuauuuauugccggcauagcagagcugggugccuucuuuuccauccuccaagauaugcggaacaccauuauggcuucaaaaacaguggggaccagcgaagagaaacuucgaaagaagaguucuuucuaccaguccuaccugcgcagaacgcagagcaugggaauccaguuggaccaaaggauaauuguccuauuuaugguugcguggggcaaggaggcaguggauaauuuccaucugggcgacgauauggaccccgaacuccggacucuggcccagucgcuuaucgacguaaaagugaaggagaucucuaaccaggaaccucugaaauuguga

SEQ ID NO: 5658 - RNA, 1290 nt, Artificial Sequence
  derived and/or modified CDS sequence (opt3) from HTNV(Aa10-434)__KT935038.1__N
auggccaccauggaggaacugcagagagagaucaacgcucacgaaggccaacucgugauugcaaggcagaagguccgggacgccgagaaacaguacgggaaggaucccgacgaacuuaauaaacgcgcgcugacagaucgagagggaguugcugugagcauacaggccaagaucgacgaguugaaacgucaauuagcagauagaauugccacugguaagaaccugggcaaggaacaggacccuacggggguagagccaggagaucaucuaaaagaaagguccaugcucucuuauggcaaugugcuggaccuuaaccaccuggauaucgacgagccgaccggucagacagcugauugguugucaauugucguguaccucaccaguuucguugugcccauccugcugaaggcacucuauauguuaacuacacgggggcgccagaccacuaaagacaauaagggaacaagaauaagguuuaaagaugacagcuccuucgaggacgucaacggcauccggaagccuaagcaucuguacgugucucuuccaaaugcccaaucgucaaugaaagcugaagagauuacccccggccgcuaucgaacggccguaugcggguuguacccugcgcagaucaaggcaagacagaugauuagcccaguuaugagugugaucggauuucuggcccuagcuaaagauugguccgacaggauagaacaguggcucucugagcccuguaagcugcuuccugauacugccgcagucagccuguuggguggcccagcuaccaaccgggacuaucuccgucaacgccagguggcccuggggaauauggaaacaaaagaguccaaggcgauuagacagcacgccgaggcagcuggaugcucaaugaucgaagauauugagaguccgagcucuaucuggguguucgccggcgcucccgacagguguccuccaacuugcuuauuuaucgccgguauugcagaacugggggccuucuuuuccauacuccaagauaugcggaacaccaucauggcuucaaaaacagucggaaccagcgaggaaaaacuucgaaagaagaguucuuucuaccaguccuaccugcgcagaacgcagagcaugggcauucaguuggaccaaaggaucauaguucuauuuaugguggcguggggcaaggaggcaguagauaauuuccaucugggggacgauauggaccccgagcuccggacucuggcccagucgcuuauugacgugaaagucaaggaaaucucuaaccaggagccucugaaauuguga

SEQ ID NO: 5659 - RNA, 1290 nt, Artificial Sequence
  derived and/or modified CDS sequence (opt3) from HTNV(Aa14-362)__KT935049.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacagggucgagcaguggcucucugaacccuguaagcugcuuccugauacugccgcagugagccuguugggagguccagcuaccaaccgggacuaucuccgucaacgccagguggcccugggcaauauggagacaaaagaguccaaggcgauaagacagcacgccgaagcagcugggugcucaaugauugaggauaucgaaaguccgagcucuauuugggucuucgccggagcucccgacagguguccuccaacuugcuuauuuaucgccggcaucgcagagcugggugccuucuuuuccauucuccaagauaugcggaacaccauaauggcuucaaaaacaguugggaccagcgaagagaaacuucgaaagaagaguucuuucuaccaguccuaccugcgcagaacgcagagcaugggaauccaguuggaccaaaggauuaucgugcuauuuaugguagcguggggcaaggaggcaguggauaauuuccaucugggcgacgauauggaccccgaacuccggacucuggcccagucgcuuauagacgucaaagugaaggagauuucuaaccaggaaccucugaaauuguga

SEQ ID NO: 5660 - RNA, 1290 nt, Artificial Sequence
  derived and/or modified CDS sequence (opt3) from HTNV(Aa14-404)__KT935052.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacugccgcagucagccuguugggagguccagcuaccaaccgggacuaucuccgucaacgccagguggcccugggcaauauggagacaaaagaguccaaggcgauuagacagcacgccgaagcagcugggugcucaaugaucgaggauauugaaaguccgagcucuaucuggguguucgccggagcucccgacagguguccuccaacuugcuuauuuaucgccggcauugcagagcugggugccuucuuuuccauacuccaagauaugcggaacaccaucauggcuucaaaaacagucgggaccagcgaagagaaacuucgaaagaagaguucuuucuaccaguccuaccugcgcagaacgcagagcaugggcauucaguuggaccaaaggaucauaguucuauuuaugguggcguggggaaaggaggcaguagauaauuuccaucugggcgacgauauggaccccgaacuccggacucuggcccagucgcuuauugacgugaaagucaaggagaucucuucccaggaaccucugaaauuguga

SEQ ID NO: 5661 - RNA, 1290 nt, Artificial Sequence
  derived and/or modified CDS sequence (opt3) from HTNV(Aa15-56)__KU207195.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucaacgaacccuguaagcugcuuccugauacugccgcagucucucuguugggagguccagcuaccaaucgggacuaucuccgucaacgccagguggcccugggcaacauggagacaaaagagagcaaggcgauuagacagcacgccgaagcagcugggugcuccaugaucgaggauauugaaucaccgaguagcaucuggguguucgccggagcucccgacagguguccuccaacuugcuuauuuaucgccggcauugcagagcugggugccuucuuuucuauacuccaagauaugcggaauaccaucauggcuuccaaaacagucgggaccucagaagagaagcugcgaaagaaaagcaguuucuaccagucuuaccuucgcagaacgcaguccaugggcauucaguuggaccaaaggaucauaguucuauuuaugguggcguggggaaaggaggcaguagauaacuuccaucugggcgacgauauggaccccgaacuccggacucuggcccagagccuuauugacgugaaagucaaggagaucucgaaucaggaaccucugaaauuguga

SEQ ID NO: 5662 - RNA, 1290 nt, Artificial Sequence
  derived and/or modified CDS sequence (opt3) from HTNV(AA1719)__AF427319.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccaucugcggcuuguacccugcgcagauuaaggcaagacagaugaucagcccaguaaugaguguuauaggguuucuggcccuagcuaaagauugguccgacaggauugagcaguggcucucugaacccuguaagcugcuuccugauacugccgcagugagccuguugggagguccagcuaccaaccgggacuaucuccgucaacgccaggucgcccugggcaauauggagacaaaagaguccaaggcgaucagacagcacgccgaagcagcugggugcucaauuaucgaggauaucgaaaguccgagcucuauuuggguguucgccggagcucccgacagguguccuccaacuugcuuauuuauagccggcaucgcagagcugggugccuucuuuuccauucuccaagauaugcggaacaccaucauggcuucaaaaacaguggggaccagcgaagagaaacuucgaaagaagaguucuuucuaccaguccuaccugcgcagaacgcagagcaugggaauacaguuggaccaaaggauuaucguccuauuuaugguugcguggggcaaggaggcaguggauaauuuccaucugggcgacgauauggaccccgaacuccggacucuggcccagucgcuuaucgacguaaaagugaaggagauuucuaaccaggaaccucugaaauuguga

SEQ ID NO: 5663 - RNA, 1290 nt, Artificial Sequence
  derived and/or modified CDS sequence (opt3) from HTNV(AP1168)__AF427323.1__N
auggccaccauggaggaacugcagaaggagaucaacgcucacgaaggccaacucgugauugcaagacagaaagucagggacgccgagcggcaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccacuaaagacaauaaggggacaagaauaagguuuaaagaugacagcuccuucgaagacgugaacggaauccggaagccuaagcaucuguacgucucucuuccaaaugcucaaucgucaaugaaagccgaggaaauuacccccggccgcuaucgaacggcgaucugcggcuuguacccugcacagauuaaggccagacagauggugagcccaguaaugaguguuaucggguuucuggcucuagccaaagauuggggagacaggauagagcaguggcucuccgaacccuguaagcugcuuccugauacugcagcugugucucugcacgguggcccagccaccaaccgggacuauuugcgucaacgccaggcggcccucgggaauauggagacaaaagagagcaaggcaauuagacagcaugcugaaacugccggaugcuccaugaucgaggauauugaaucaccgaguagcaucugggucuucgcuggcgcccccgacagguguccuccaaccugccuguuuaucgcagguauugccgaguuaggggcuuucuuuucuauacugcaagauaugcggaacacaaucauggcguccaaaaccgugggaacgucagaagagaagcuccgaaagaaaagcaguuucuaccagucuuaccuucgcagaacucaguccaugggcauucagcuggaccaaaggaucauaguguuguuuauggucgcauggggcaaggaggccguugauaauuuccaccuaggggacgauauggaccccgaacugcggacacucgcucagagccugauugaccuuaaagugaaggagaucucgaaccaggaaccucugaaauuguga

SEQ ID NO: 5664 - RNA, 1290 nt, Artificial Sequence
  derived and/or modified CDS sequence (opt3) from HTNV(AP708)__AF427322.1__N
auggccaccauggaggaacugcagaaggagaucaacgcucacgaaggccaacucgugauugcaagacagaaagucagggacgccgagcggcaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccacuaaagacaauaaggggacaagaauaagguuuaaagaugacagcuccuucgaagacgugaacggaauccggaagccuaagcaucuguacgucucucuuccaaaugcucaaucgucaaugaaagccgaggaaauuacccccggccgcuaucgaacggcgaucugcggcuuguacccugcacagauuaaggccagacagauggugagcccaguaaugaguguuaucggguuucuggcucuagccaaagauuggggagacaggauagagcaguggcucuccgaacccuguaagcugcuuccugauacugcagcugugucucugcacgguggcccagccaccaaccgggacuauuugcgucaacgccaggcggcccucgggaauauggagacaaaagagagcaaggcaauuagacagcaugcugaaacugccggaugcuccaugaucgaggauauugaaucaccgaguagcgucuggguguucgcuggcgcccccgacagguguccuccaaccugccuguuuaucgcagguaucgccgaguuaggggcuuucuuuucuauucugcaagauaugcggaacacaauaauggcguccaaaaccgugggaacgucagaagagaagcuccgaaagaaaagcaguuucuaccagucuuaccuucgcagaacucaguccaugggcauccagcuggaccaaaggauuaucgucuuguuuaugguugcauggggcaaggaggccguggauaauuuccaccuaggggacgauauggaccccgaacugcggacacucgcucagagccugauagaccuuaaaguaaaggagauuucgaaccaggaaccucugaaauuguga

SEQ ID NO: 5665 - RNA, 1290 nt, Artificial Sequence
  derived and/or modified CDS sequence (opt3) from HTNV(DandongHu-32)__KC570386.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccaucugcggcuuguacccugcgcagauuaaggcaagacagaugaucagcccaguaaugaguguuauaggguuucuggcccuagcuaaagauugguccgacaggauugagcaguggcucucugaacccuguaagcugcuuccugauacugccgcagugagccuguugggagguccagcuaccaaccgggacuaucuccgucaacgccaggucgcccugggcaauauggagacaaaagaguccaaggcgaucagacagcacgccgaagcagcugggugcucaaugauugaggauaucgaaaguccgagcucuaucuggguguucgccggagcucccgacagguguccuccaacuugcuuauuuauugccggcauagcagagcugggugccuucuuuuccauccuccaagauaugcggaacaccauuauggcuucaaaaacaguggggaccagcgaagagaaacuucgaaagaagaguucuuucuaccaguccuaccugcgcagaacgcagagcaugggaauccaguuggaccaaaggauaauuguccuauuuaugguugcguggggcaaggaggcaguggauaauuuccaucugggcgacgauauggaccccgaacuccggauccuggcccagucgcuuaucgacguaaaagugaaggagauuucuaaccaggaaccucugaaauuguga

SEQ ID NO: 5666 - RNA, 1290 nt, Artificial Sequence
  derived and/or modified CDS sequence (opt3) from HTNV(DandongHu-34)__KC570387.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccaucugcggcuuguacccugcgcagauuaaggcaagacagaugaucagcccaguaaugaguguuauaggguuucuggcccuagcuaaagauugguccgacaggauugagcaguggcucucugaacccuguaagcugcuuccugauacugccgcagugagccuguugggagguccagcuaccaaccgggacuaucuccgucaacgccaggucgcccugggcaauauggagacaaaagaguccaaggcgaucagacagcacgccgaagcagcugggugcucaaugauugaggauaucgaaaguccgagcucuaucuggguguucgccggagcucccgacagguguccuccaacuugcuuauuuauugccggcauggcagagcugggugccuucuuuuccauacuccaagauaugcggaacaccaucauggcuucaaaaacaguggggaccagcgaagagaaacuucgaaagaagaguucuuucuaccaguccuaccugcgcagaacgcagagcaugggcauucaguuggaccaaaggaucauaguccuauuuaugguugcguggggaaaggaggcaguggauaauuuccaucugggcgacgauauggaccccgaacuccggacucuggcccagucgcuuauugacguaaaagugaaggagaucucuaaccaggaaccucugaaauuguga

SEQ ID NO: 5667 - RNA, 1290 nt, Artificial Sequence
  derived and/or modified CDS sequence (opt3) from HTNV(DandongHu-89)__KC570389.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucugugcgugucucuuccaaaugcccaaucgucaaugaaagcugaggaaauuacccccggccgcuaccgaacggccaucuguggcuuguauccugcgcagauuaaggcaagacagaugaucagcccaguaaugaguguuauaggguuucuggcccuagcuaaagauugguccgacaggauugagcaguggcucucugaacccugcaagcugcuuccugauacugccgcagugagccuguugggagguccagcuaccaaccgggacuaccuccgucaacgccaggucgcccugggcaauauggagacaaaagaguccaaggcgaucagacagcacgccgaagcagcuggguguucaaugauugaggauaucgaaaguccgagcucuaucuggguguucgccggagcucccgacaggugcccuccaacuuguuuauuuauugccggcauagcagagcugggugccuucuuuuccauccuccaagauaugcggaacaccauuauggcuucaaaaacaguggggaccagcgaagagaaacuucgaaagaagaguucuuucuaucaguccuaccugcgcagaacgcagagcaugggaauccaguuggaccaaaggauaauuguccuauuuaugguugcguggggcaaggaggcaguggauaauuuccaucugggcgacgauauggaccccgaacuccggacucuggcccagucgcuuaucgacguaaaagugaaggagaucucuaaccaggaaccucugaaauuguga

SEQ ID NO: 5668 - RNA, 1290 nt, Artificial Sequence
  derived and/or modified CDS sequence (opt3) from HTNV(DandongHu-91)__KC570390.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguuggguauugucaucuaccucacuucauucgugguucccauacugcugaaggcacucuauauguuaaccacacgggggcgccagaccacuaaagacaauaagggaacaagaaucagguuuaaagaugacaguagcuucgaagacgugaacggcauucggaagccuaagcaucuguacgucucccuuccaaaugcccaaucuucgaugaaagcugaggaaaucacccccggccgcuaucgaacggccauuugcggguuguacccugcgcagaucaaggcaagacagaugauaucaccagugaugagcguaauuggauuucuggcccuagcuaaagauuggagugacaggaucgagcaguggcucuccgaacccuguaagcugcuuccugauacugccgcaguuucucuguuggguggcccagcuaccaaccgggacuaucuccgucaacgccagguggcccuggggaauauggagacaaaagagagcaaggcgauuagacagcacgccgaagcagcuggaugcuccaugaucgaggauaucgaaucaccgaguagcauuugggucuucgccggcgcucccgacagguguccuccaacuugcuuauuuauagccgguauggcagagcugggggccuucuuuucuauccuccaagauaugcggaacaccauuauggcuuccaaaacagugggaaccucagaagagaagcugcgaaagaaaagcaguuucuaccagucuuaccuucgcagaacgcaguccaugggcauccaguuggaccaaaggauaauugugcuauuuauggucgcguggggcaaggaggcaguugauaauuuccaucugggggacgauauggaccccgaacuccggacucuggcccagagccuuaucgacgugaaaguaaaggagaucucgaaccaggaaccucugaaauuguga

SEQ ID NO: 5669 - RNA, 1290 nt, Artificial Sequence
  derived and/or modified CDS sequence (opt3) from HTNV(Fuyuan-Aa-145)__KJ857349.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccaucugcggcuugcacccugcgcagauuaaggcaagacagaugaucagcccaguaaugaguguuauaggguuucuggcccuagcuaaagauugguccgacaggauugagcaguggcucucugaacccuguaagcugcuuccugauacugccgcagugagccuguugggagguccagcuaccaaccgggacuaccuccgucaacgccaggucgcccugggcaauauggagacaaaagaguccaaggcgaucagacagcaugccgaagcagcugggugcucaaugauugaggauaucgaaaguccgagcucuaucuggguguucgccggagcucccgacagguguccuccaacuugcuuauuuauugccggcauagcagagcugggugccuucuuuuccauccuccaagauaugcggaacaccauuauggcuucaaaaacaguggggaccagcgaagagaaacuucgaaagaagaguucuuucuaucaguccuaccugcgcagaacgcagagcaugggaauccaguuggaccaaaggauaauuguccuauuuaugguugcguggggcaaggaggcaguggauaauuuccaccugggcgacgauauggaccccgaacuccggacucuggcccagucgcuuaucgacguaaaagugaaggagaucucuaaccaggaaccucugaaauuguga

SEQ ID NO: 5670 - RNA, 1290 nt, Artificial Sequence
  derived and/or modified CDS sequence (opt3) from HTNV(Fuyuan-Aa-26)__KJ857347.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucgcaguucccauccugcugaaggcccucuauauguuaacuacacggggucgccagaccacuaaagacaauaaggggacaagaauaagguuuaaagaugacagcucccuggaagacgugaacggaauccggaagccuaagcaucuuuacgucucuuugccaaaugcucaaucgucaaugaaagccgaggaaauuacccccggccgcuaucgaacggcgaucugcggccuguacccugcacagauuaaggccagacagaugaucagcccagugaugaguguaauaggguuccuagcucucgccaaagauugguccgacaggauugagcaguggcugucugaacccuguaaacuucugccugauacugcagcuguuagcuugcucggagguccagccaccaaccgggacuaucugcgucaacgccagguggcguuaggcaauauggagacaaaggaguccaaggccaucagacagcacgcagaagcugccgggugcucaaugauugaggauaucgaaaguccgagcucuaucugggucuuugcuggagcccccgacagguguccuccaacuugccccuucauugcaggcauagccgagcugggugcguuuuucuccauccuccaagauaugcggaacaccauuauggcuucaaaaacaguggggaccagcgaagagaaacuucgaaagaagaguucuuuuuaccaguccuaccugcgcagaacgcagagcaugggaauccaguuggaccaaaggauaauugugcuauucauggucgcauggggcaaggaggccguugauaauuuucaucugggcgacgauauggacccugaacuccggacucuggcucagucgcuuaucgacgugaaaguaaaggagaucucuaaccaggaaccacugaaauuguga

SEQ ID NO: 5671 - RNA, 1290 nt, Artificial Sequence
  derived and/or modified CDS sequence (opt3) from HTNV(JS1)__KP970572.1__N
auggccaccauggaggaacugcagagagagaucaacgcucacgaaggccaacucgugauugcaaggcagaagguccgggacgccgagaaacaguacgaaaaugaucccgacgagcuuaacaagcgcgcgcugacaaaucgagaggggguugcugugagcauacaggccaaaaucgaugaauugaagcgucaauuagcagacagaauugccacuggaaagaaccuggguaaggagcaggauccuacgggcguagaaccaggggaccaucuaaaggagagguccaugcucucuuauggaaaugugcuggaucuuaaccaccuggacaucgaugagccgaccggccagacagcugacugguugucaauuaucgucuaccucaccaguuucgugguucccauacugcugaaagcacucuauauguuaacuacacggggucgccagaccacuaaggauaauaaagggacaagaaucagguuuaaggacgauagcuccuucgaagacgugaacggcauucggaaaccuaagcaucuguacgucucucuuccaaaugcccaaucgucaaugaaggcugaggaaaucacccccggacgcuaucgaacggccgugugcggcuuguacccugcgcagauuaaagcaagacagaugaucagcccaguaaugaguguuauaggguuucuggcccuagcuaaggacugguccgauaggauugagcaguggcucaucgaacccuguaaacugcuuccugacacugccgcagugucucuguugggagguccagcuaccaaccgggauuaucuccgucaacgccaggucgcccugggcaauauggagacaaaggagagcaaagcgauuagacagcacgccgaagcagcugggugcuccaugaucgaggacaucgaaucaccgaguagcauuuggguguucgccggagcucccgauagguguccuccaacuugcuuauuuauagccggcaucgcagagcugggugccuucuuuucuauucuccaagacaugcggaacaccaucauggcuuccaagacaguggggaccucagaagagaaacuucgaaagaaaagcaguuucuaccagucuuaccugcgcagaacgcaguccaugggaauacaguuggaucaaaggauuaucguccuauuuaugguugcguggggcaaagaggcaguggacaauuuccaucugggcgaugacauggaucccgaacuccggacucuggcccagagccuuaucgacguaaaggugaaagagauuucgaaccaggaaccucugaaguuguga

SEQ ID NO: 5672 - RNA, 1290 nt, Artificial Sequence
  derived and/or modified CDS sequence (opt3) from HTNV(LongquanAa-08-150)__JQ912697.1__N
auggccaccauggaggaacugcagagagagaucgacgcucacgaaggccaacucgugauugcaaggcagaagguccgggaugccgagaaacaguacgaaaaggaccccgaugagcuuaacaaacgcgcgcugacagaccgagaggggguugcugccagcauacaggcaaagaucgaugaauugaaacgucaauuagccgacagaauugcuacuggaaagaaucuggguaaggagcaggauccuacgggcguggaaccaggggaccaucuaaaagagagguccaugcucucuuauggaaacguacuggaucuuaaucaccuggacaucgaugagccgaccggccagacagcagacugguugucaauuguggucuaccucaccaguuucgugguucccauccugcugaaggcccucuauauguuaacuacacggggucgccagaccacuaaagauaacaaggggacaagaauaagguuuaaagacgacagcuccuucgaagaugugaauggaauccggaagccuaagcaucuguacgucucucuuccaaacgcucaaucgucaaugaaagccgaggaaauuacccccggccgcuaucgaacggcgaucugcggcuuguacccugcacagauuaaggccagacagaugaucagcccagugaugaguguaauaggguuucuggcucuagccaaagacugggcagauaggauugagcaguggcucuccgaacccuguaagcugcuuccugacacugcugccguuucucugcacggagguccagcgaccaaucgggauuauuugcgucaacgccagguggcccucggcaacauggagacaaaagagagcaaggcaaucagacagcaugcugaaacugccgggugcuccaugauugaggacaucgaaucaccgaguagcaucugggucuucgcuggagcccccgauagguguccuccaaccugccuguuuauugcaggcauagccgaguuaggugcuuucuuuucuauccugcaagacaugcggaauacaauuauggcguccaaaaccguggggacgucagaagagaagcuccgaaagaaaagcaguuucuaccagucuuaccuucgcagaacucaguccaugggaauccagcuggaucaaaggauaauuguguuguuuauggucgcauggggcaaggaggccguugacaacuuccaccuaggcgaugacauggaccccgaacugcggacacucgcucagagccugaucgaugugaaaguaaaggagaucucgaaucaggaaccucuuaaacuguga

SEQ ID NO: 5673 - RNA, 1290 nt, Artificial Sequence
  derived and/or modified CDS sequence (opt3) from HTNV(LongquanAa-08-157)__JQ912698.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccacuaaagacaauaaggggacaagaauaagguuuaaagaugacagcuccuucgaagacgugaacggaauccggaagccuaagcaucuguacgucucucuuccaaaugcucaaucgucaaugaaagccgaggaaauuacccccggccgcuaucgaacggcgaucugcggcuuguacccugcacagauuaaggccagacagaugaucagcccagugaugaguguaauaggguuucuggcucuagccaaagauugggcagacaggauugagcaguggcucuccgaacccuguaagcugcuuccugauacugcugccguuucucugcacggagguccagcgaccaaccgggacuauuugcgucaacgccagguggcccucggcaauauggagacaaaagagagcaaggcaaucagacagcaugcugaaacugccgggugcuccaugauugaggauaucgaaucaccgaguagcaucugggucuucgcuggagcccccgacagguguccuccaaccugccuguuuauugcaggcauagccgaguuaggugcuuucuuuucuauccugcaagauaugcggaacacaauuauggcguccaaaaccguggggacgucagaagagaagcuccgaaagaaaagcaguuucuaccagucuuaccuucgcagaacucaguccaugggaauccagcuggaccaaaggauaauuguguuguuuauggucgcauggggcaaggaggccguugauaauuuccaccuaggcgacgauauggaccccgaacugcggacacucgcucagagccugaucgacgugaaaguaaaggagaucucgaaccaggaaccucuuaaacuguga

SEQ ID NO: 5674 - RNA, 1290 nt, Artificial Sequence
  derived and/or modified CDS sequence (opt3) from HTNV(LongquanAa-08-314)__JQ912709.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcaugcaggcaaagauagacgaauugaaacgucaauuagccgauagaaucgcuacuggaaagaaccuggguaaggagcaggacccuacgggcguggaaccaggggaucaucuaaaagagagguccaugcucucuuauggaaauguacuggaccuuaaccaccuggauauugacgagccgaccggccagacagcagauugguugucaaucguggucuaccucaccaguuucgugguucccauucugcugaaggcccucuauauguuaacuacacggggucgccagaccacuaaagacaauaaggggacaagaaucagguuuaaagaugacagcuccuucgaagacgugaacggaauacggaagccuaagcaucuguacgucucucuuccaaaugcucaaucgucaaugaaagccgaggaaaucacccccggccgcuaucgaacggcgauuugcggcuuguacccugcacagaucaaggccagacagaugauuagcccagugaugaguguaaucggguuucuggcucuagccaaagauugggcagacaggauagagcaguggcucuccgaacccuguaagcugcuuccugauacugcugccguuucucugcacggagguccagcgaccaaccgggacuauuugcgucaacgccagguggcccucggcaauauggagacaaaagagagcaaggcaauuagacagcaugcugaaacugccgggugcuccaugaucgaggauauugaaucaccgaguagcaucugggucuucgcuggagcccccgacagguguccuccaaccugccuguuuaucgcaggcauugccgaguuaggugcuuucuuuucuauacugcaagauaugcggaacacaaucauggcguccaaaaccguggggacgucagaagagaagcuccgaaagaaaagcaguuucuaccagucuuaccuucgcagaacucaguccaugggcauucagcuggaccaaaggaucauaguguuguuuauggucgcauggggaaaggaggccguugauaauuuccaccuaggcgacgauauggaccccgaacugcggacacucgcucagagccugauugacgugaaaguaaaggagaucucgaaccaggaaccucuuaaacuguga

SEQ ID NO: 5675 - RNA, 1290 nt, Artificial Sequence
  derived and/or modified CDS sequence (opt3) from HTNV(LongquanAa-08-573)__JQ912714.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccacuaaagacaauaaggggacaagaauaagguuuaaagaugacagcuccuucgaagacgugaacggaauccggaagccuaagcaucuguacgucucucuuccaaaugcucaaucgucaaugaaagccgaggaaauuacccccggccgcuaucgaacggcgaucugcggcuuguacccugcacagauuaaggccagacagaugaucagcccagugaugaguguaauaggguuucuggcucuagccaaagauugggcagacaggauugagcaguggcucuccgaacccuguaagcugcuuccugauacugcugccguuucucugcacggagguccagcgaccaaccgggacuauuugcgucaacgccagguggcccucggcaauauggagacaaaagagagcaaggcaaucagacagcaugcugccacugcugggugcuccaugauugaagauaucgagucaccgaguagcaucugggucuucgccggagcacccgacagguguccuccaaccugccuguuuauugccggcauagcugaauuaggugcguucuuuucuauccugcaagauaugcggaacacaauuauggcauccaaaaccguggggacgucagaggaaaagcuccgaaagaaaagcaguuucuaccagucuuaccuucgcagaacucaguccaugggaauccagcuggaccaaaggauaauuguguuguuuauggucgccuggggcaaggaggcuguugauaauuuccaccuaggcgacgauauggaccccgagcugcggacacucgcccagagccugaucgacgugaaaguaaaggaaaucucgaaccaggagccucuuaaacuguga

SEQ ID NO: 5676 - RNA, 1290 nt, Artificial Sequence
  derived and/or modified CDS sequence (opt3) from HTNV(LongquanAa-09-113)__JQ912716.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccacuaaagacaauaaggggacaagaauaagguuuaaagaugacagcuccuucgaagacgugaacggaacccggaagccuaagcaucuguacgucucucuuccaaaugcucaaucgucaaugaaagccgaggaaaucacgcccggccgcuaucgaacugcgauuugcggcuuguacccugcacagaucaaggccagacagaugauuagcccagugaugaguguaaucggguuucuggcucuagccaaagauugggcagacaggauagagcaguggcucuccgaacccuguaagcugcuuccugauaccgcugccguuucucugcacggagguccagcgacaaaccgggacuauuugcgucaacgccagguggcccucggcaauauggagacuaaagagagcaaggcaauuagacagcaugcugaaaccgccgggugcuccaugaucgaggauauugaaucaccgaguagcaucugggucuucgcuggagcccccgacagguguccuccaacaugccuguuuaucgcaggcauugccgaguuaggugcuuucuuuucuauacugcaagauaugcggaacaccaucauggcguccaaaacgguggggacuucagaagagaagcuccgaaagaaaagcaguuucuaccagucuuaccuucgcagaacacaguccaugggcauucagcuggaccaaaggaucauaguguuguuuauggucgcauggggaaaggaggccguugauaauuuccaccuaggcgacgauauggaccccgaacugcggacccucgcucagagccugauugacgugaaaguaaaggagaucucgaaccaggaaccucuuaaacuguga

SEQ ID NO: 5677 - RNA, 1290 nt, Artificial Sequence
  derived and/or modified CDS sequence (opt3) from HTNV(LongquanAa-09-191)__JQ912719.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucaccaguuucgugguucccauccugcugaaggcccucuauauguuaacuacacggggucgccagaccauaaaagacaauaaggggacuagaaucagguuuaaagaugacagcuccuucgaagacgugaacggcauucggaagccuaagcaucuguacgucucucuuccaaaugcucaaucgucaaugaaagccgaggaaaucacacccggacgcuaucgaaccgcgauuugcggcuuguacccugcacagaucaaggccagacagaugauaagcccagugaugaguguaauuggguuucuggcucuagccaaagauugggcagacaggaucgagcaguggcucuccgaacccuguaagcugcuuccugauacggcugccguuucucugcacggagguccagcgacuaaccgggacuauuugcgucaacgccagguggcccucggcaauauggagaccaaagagagcaaggcaauuagacagcaugcugaaacagccgggugcuccaugaucgaggauaucgaaucaccgaguagcauuugggucuucgcuggagcccccgacagguguccuccaacuugccuguuuauagcaggcaucgccgaguuaggugcuuucuuuucuauucugcaagauaugcggaacaccaucauggcguccaaaacaguggggaccucagaagagaagcuccgaaagaaaagcaguuucuaccagucuuaccuucgcagaacgcaguccaugggaauacagcuggaccaaaggauuaucguguuguuuauggucgcauggggcaaggaggccguugauaauuuccaccuaggcgacgauauggaccccgaacugcggacucucgcucagagccugaucgacgugaaaguaaaggagauuucgaaccaggaaccucuuaaacuguga

SEQ ID NO: 5678 - RNA, 1290 nt, Artificial Sequence
  derived and/or modified CDS sequence (opt3) from HTNV(LongquanAa-09-192)__JQ912720.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcaugcagggaaagauagacgaauugaaacgucaauuagcagauagaaucgccacugguaagaaccugggcaaggagcaggacccuacggggguggaaccaggagaucaucuaaaagagagguccaugcucucuuauggcaauguacuggaccuuaaccaccuggauauugacgagccgaccggucagacagcugauugguugucaaucguggucuaccucaccaguuucgugguucccauucugcugaaggcacucuauauguuaacuacacgggggcgccagaccacuaaagacaauaagggaacaagaaucagguuuaaagaugacagcuccuucgaagacgugaacggcauacggaagccuaagcaucuguacgucucucuuccaaaugcccaaucgucaaugaaagcugaggaaaucacccccggccgcuaucgaacggccauuugcggguuguacccugcgcagaucaaggcaagacagaugauuagcccagugaugaguguaaucggauuucuggcccuagcuaaagauugggccgacaggauagagcaguggcucuccgaacccuguaagcugcuuccugauacugcagcuguuucucugcacgguggcccagccaccaaccgggacuauuugcgucaacgccagguggcgcucgggaauauggagacaaaagagagcaaggccauuagacagcaugcagaaacugcuggaugcuccaugaucgaggauauugaaucaccgaguagcaucugggucuucgccggcgcucccgacagguguccuccaaccugccuguuuaucgccgguauugcagaguuaggggccuucuuuucuauacugcaagauaugcggaacacaaucauggcuuccaaaaccgugggaacgucagaagagaagcuccgaaagaaaagcaguuucuaccagucuuaccuucgcagaacucaguccaugggcauucagcuggaccaaaggaucauaguguuguuuauggucgcguggggcaaggaggcaguugauaauuuccaccuaggggacgauauggaccccgaacugcggacacucgcccagagccugauugacgugaaaguaaaggagaucucgaaccaggaaccucuuaaacuguga

SEQ ID NO: 5679 - RNA, 1290 nt, Artificial Sequence
  derived and/or modified CDS sequence (opt3) from HTNV(LongquanAa-10-46)__JQ912754.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauuguggucuaccucacuagcuucgugguucccauccugcugaaggcccucuauauguuaaccacacggggucgccagaccacuaaagacaauaaggggacaagaauaagguuuaaagaugacagcuccuucgaagacgugaacggaauccggaagccugagcaucuguacgucucucuuccaaaugcucaaucgucaaugaaggccgaagagauuacccccggccgcuaucgaacggcgaucugcggcuuguacccugcacagauuaaagccagacagaugaucagcccagugaugaguguaauaggguuucuggcucuagccaaggauugggcagacaggauugaacaguggcucuccgagcccuguaaacugcuuccugauacugcugccguuucucugcacggagguccagcgaccaaccgggacuauuugcgucaacgccagguggcccucggcaauauggagacaaaggaaagcaaagcaaucagacagcaugcugagacugccgggugcuccaugauugaagauaucgagucaccgaguagcaucugggucuucgcuggagcccccgacagguguccuccaaccugccuguuuauugcaggcauagccgaauuaggugcuuucuuuucuauccugcaagauaugcggaacacaauuauggcguccaagaccguggggacgucagaggagaaacuccgaaagaagaguaguuucuaccagucuuaccuucgcagaacucaguccaugggaauccagcuggaccaaaggauaauuguguuguuuauggucgcauggggcaaagaagccguugauaauuuccaccuaggcgacgauauggaccccgagcugcggacacucgcucagagccugaucgacgugaagguaaaagaaaucucgaaccaggagccucuuaagcuguga

SEQ ID NO: 5680 - RNA, 1290 nt, Artificial Sequence
  derived and/or modified CDS sequence (opt3) from HTNV(LongquanAa-11-745)__KC344237.1__N
auggccaccauggaggaacugcagaaggagaucaacgcucacgaaggccaacucgugauugcaagacagaaagucagggacgccgagaagcaguacgaaaaagaucccgacgagcuuaauaagcgggcgcugacagaucgcgaggggguugcugccagcauacaggcaaaaaucgacgaauugaagcgacaauuagccgaucguauugcuacuggaaagaaccuggguaaagagcaggacccuacgggcguggaaccaggggaucaucuaaaggagagauccaugcucucuuauggaaauguacuggaccuuaaccaccuggauaucgacgagccgaccggccagacagcagauugguugucaauuguggucuaccucaccaguuucgugguucccauccugcugaaagcccucuauauguuaacuacaaggggucggcagaccacuaaggacaauaaagggacacgcauaagauuuaaggaugacagcuccuucgaagacgugaacggaaucaggaagccuaaacaucuguacgucucucuuccaaaugcucaaucgucaaugaaggccgaggaaauuacccccggccgguaucgcacggcgaucugcggcuuguacccugcacagauuaaagcccgacagaugaucagcccagugaugaguguaauaggguuucuggcucuagccaaggauugggcagacagaauugagcaguggcucuccgaacccuguaaacugcuuccugauacugcugccguuucucugcacggagguccagcgaccaacagggacuauuugcggcaacgucagguggcccucggcaauauggagacaaaggagagcaaagcaauccgccagcaugcugaaacugccgggugcuccaugauugaggauaucgaaucaccgaguagcaucugggucuucgcuggagcccccgacagauguccuccaaccugccuguuuauugcaggcauagccgaguuaggugcuuucuuuucuauccugcaagauaugaggaacacaauuauggcguccaagaccguggggacgucagaagagaagcuccggaaaaagagcaguuucuaccagucuuaccuucgacgcacucaguccaugggaauccagcuggaccaaagaauaauuguguuguuuauggucgcauggggcaaagaggccguugauaauuuccaccuaggcgacgauauggaccccgaacugaggacacucgcucagagccugaucgacgugaagguaaaagagaucucgaaccaggaaccucuuaagcuguga

SEQ ID NO: 5681 - RNA, 1290 nt, Artificial Sequence
  derived and/or modified CDS sequence (opt3) from HTNV(ROKA14-11)__KU207207.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacugccgcagucagccuguugggagguccagcuaccaaccgggacuaucuccgucaacgccagguggcccugggcaauauggagacaaaagaguccaaggcgauuagacagcacgccgaagcagcugggugcucaaugaucgaggauauugaaaguccgagcucuaucuggguguucgccggagcucccgacagguguccuccaacuugcuuauuugucgccggcaucgcagagcugggugccuucuuuuccauucuccaagauaugcggaacaccauaauggcuucaaaaacaguugggaccagcgaagagaagaugcgaaagaaaaguucuuucuaccaguccuaccuucgcagaacgcagagcaugggaauccagcuggaccaaaggauuaucguguuguuuaugguagcguggggcaaggaggcaguggauaauuuccaucuaggcgacgauauggaccccgaacugcggacucucgcccagucgcugauagacgucaaagugaaggagauuucuaaccaggaaccucuuaaacuguga

SEQ ID NO: 5682 - RNA, 1290 nt, Artificial Sequence
  derived and/or modified CDS sequence (opt3) from HTNV(US8A14-2)__KU207208.1__N
auggccaccauggaggaacugcagagagagaucaacgcucacgaaggccaacucgugauugcaaggcagaagguccgggacgccgagaaacaggaugggaaggaccccgaugaacuuaauaaacgcgcgcugacagaccgagagggaguugcugugagcauacaggccaagaucgaugaguugaaacgucaauuagcagacagaauugccacugguaagaaccugggcaaggaacaggauccuacggggguagagccaggagaccaucuaaaagaaagguccaugcucucuuacggcaaugugcuggaucuuaaccaccuggacaucgaugagccgaccggucagacagcugacugguugucaauugucguguaucucaccaguuucguugugcccauccugcugaaggcacucuacauguuaacuacacgggggcgccagaccacuaaagauaauaagggaacaagaauaagguuuaaagacgacagcuccuucgaggaugucaacggcauccggaagccuaagcaucuguaugugucucuuccaaaugcccaaucgucaaugaaagcugaagagauuacccccggccgcuaccgaacggccguaugcggguuguauccugcgcagaucaaggcaagacagaugauuagcccaguuaugagugugaucggauuucuggcccuagcuaaagacugguccgauaggauagaacaguggcucucugagcccuguaagcugcuuccugacacugccgcagucagccuguuggguggcccagcuaccaaccgggauuaccuccgucaacgccagguggcccuggggaauauggaaacaaaagaguccaaggcgauuagacagcacgccgaggcagcuggaugcucaaugaucgaagacauugagaguccgagcucuaucuggguguucgccggcgcucccgauagguguccuccaacuugcuuauuuaucgccgguauugcagaacugggggccuucuuuuccauacuccaagacaugcggaacaccaucauggcuucaaaaacagucggaaccagcgaggaaaaacuucgaaagaagaguucuuucuaucaguccuaccugcgcagaacgcagagcaugggcauucaguuggaucaaaggaucauaguucuauuuaugguggcguggggcaaggaggcaguagacaauuuccaucugggggaugacauggaccccgagcuccggacucuggcccagucgcuuauugaugugaaagucaaggaaaucucuaaccaggagccucugaaauuguga

SEQ ID NO: 5683 - RNA, 1290 nt, Artificial Sequence
  derived and/or modified CDS sequence (opt3) from HTNV(US8A15-1)__KU207209.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucucugaacccuguaagcugcuuccugauacugccgcagucagccuguugggagguccagcuaccaaccgggacuaucuccgucaacgccagguggcccugggcaauauggagacaaaagaguccaaggcgauuagacagcacgccgaagcagcugggugcucaaugaucgaggauauugaaaguccgagcucuaucuggguguucgccggagcucccgacagguguccuccaacuugcuuauuuaucgccggcauugcagagcugggugccuucuuuuccauacuccaagauaugcggaacaccaucauggcuucaaaaauugucgggacaagcgaagagaaacuucgaaagaagaguucuuucuaccaguccuaccugcgcagaacccagagcaugggaauccaguuggaccaaaggauaauuguucuauuuaugguggcguggggcaaggaggcaguagauaauuuccaucugggcgacgauauggaccccgaacuccggacgcuggcccagucgcuuaucgacgugaaagucaaggagaucucuaaccaggaaccucugaaauuguga

SEQ ID NO: 5684 - RNA, 1290 nt, Artificial Sequence
  derived and/or modified CDS sequence (opt3) from HTNV(YaluRiver13)__HQ611981.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggugggcagaccacuaaagacaauaagggaacacgcauaagauuuaaagaugacagcuccuucgaagacgucaacggcaucaggaagccuaagcaucuguacgugucucuuccaaaugcccaaucgucaaugaaagcugaggaaauuacccccggccgguaucgcacggccaucugcggguuguacccugcgcagauuaaggcacgacagaugaucagcccaguaaugaguguuauaggauuucuggcccuagcuaaagauugguccgacagaauugagcaguggcucucugaacccuguaagcugcuuccugauacugccgcagugagccuguuggguggcccagcuaccaacagggacuaucuccggcaacgucaggucgcccuggggaauauggagacaaaagaguccaaggcgauccgccagcacgccgaagcagcuggaugcucaaugauugaggauaucgaaaguccgagcucuaucuggguguucgccggcgcucccgacagauguccuccaacuugcuuauuuauugccuccauaggugagcugggggcauucuuuucaauccuccaagauaugaggaacaccauuauggccagcaaaacagugggaaccagugaagagaaacuucggaagaagucuuccuucuaccagagcuaccugcgacgcacgcagucgaugggcauccaguuggaccaaagaauaauuguccuauuuaugguuucuuggggcaaggaggcuguggauaauuuccaucugggggacgauauggaccccgaacucaggacucuggcgcagucccuuaucgacguaaaagugaaggagaucccuaaccaggaaccacugaaauuguga

SEQ ID NO: 5685 - RNA, 1290 nt, Artificial Sequence
  derived and/or modified CDS sequence (opt3) from HTNV(84FLi)__AY017064.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaacuaccuggauaucgacgagccgacaggccagacugcugauugguugucaauugugaucuaucucaccaguuucgucgugcccauacugcugaaggcacucuacauguuaacaacccggggucgccagacuacaaaagacaauaaggggaccagaaucagguuuaaagaugacagcuccuucgaagacguuaacggcauucggaagccuaagcaccuguaugugucucuuccaaaugcccaaucgucaaugaaagcugaggaaaucacgcccggacgcuaccgaacugccauuugcggcuuguauccugcgcagaucaaggcaagacagaugauaagcccagucaugagugugauuggguuucuggcccuagcuaaagauugguccgacaggaucgagcaguggcucucugaacccuguaagcugcuuccugauaccgccgcaguaagccugcauggagguccagcuacaaaccgggacuacuugcgucaacgccagguugcccucggcaauauggagacuaaagaguccaaggcgauuagacagcacgccgaaucagcagggugcaguaugaucgaggauaucgaaagcccgucuuccauuuggguguucgcuggagcccccgacagguguccuccaaccugccuguuuauagcuggcaucgccgaguuaggugcauucuuuucaauucugcaagauaugcggaacacaaucauggccagcaaaaccgucgggacgagugaagagaagcuccgaaagaaaucuuccuucuaccagagcuaucuucgcagaacucagucgaugggaauacagcuggaccaaaggauuaucguguuguuuaugguggcuuggggcaaggaggcggucgauaauuuccaucuaggcgacgauauggaccccgaacugcggacacucgcacagucucugaucgacguuaaagugaaggagauuuccaaccaggaaccucuuaaacuguga

SEQ ID NO: 5686 - RNA, 1290 nt, Artificial Sequence
  derived and/or modified CDS sequence (opt3) from HTNV(Bao14)__AB127998.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaaccuggguaaggagcaggacccuaccggcguagaaccaggggaucaucuaaaagagagguccaugcucucuuauggaaaugugcuggaccuuaaccaccuggauaucgacgagccgacaggccagacugccgauugguugucaauugucguguaccucaccaguuucguugugcccauccugcugaaggcucucuauauguuaacaacccggggucgccagacuacaaaagacaauaaggggaccagaauaagguuuaaagaugacagcuccuucgaagacgucaacggaauccggaagccuaagcaucuguacgugucucuuccaaaugcacaaucgucaaugaaagccgaggaaauuacgcccggccgcuaucgaacugcuaucugcggcuuguacccugcccagauuaaggcgagacagaugaucagcccaguaaugaguguuauaggguuucuggcacuagccaaagauugguccgacaggauugagcaguggcucucugaacccuguaagcugcuuccugauaccgcugccgugagccuguugggagguccagcaacaaaccgggacuaucuccgucaacgccaggucgcucugggcaauauggagacuaaagaguccaaggccaucagacagcacgcggaagccgcagggugcucaaugauugaggauaucgaaaguccgagcucuaucuggguguucgcuggagcccccgacagguguccuccaaccugcuuauuuauugcuggcauagccgagcugggugcauucuuuuccauccuccaagauaugcggaacacaauuauggccucaaaaaccguggggacgagcgaagagaaacuucgaaagaagaguucuuucuaccaguccuaccugcgcagaacucagagcaugggaauccaguuggaccaaaggauaauuguccuauuuaugguugcuuggggcaaggaggcgguggauaauuuccaucugggcgacgauauggaccccgaacuccggacacuggcacagucgcuuaucgacguaaaagugaaggagaucucuaaccaggaaccucugaaauuguga

SEQ ID NO: 5687 - RNA, 1290 nt, Artificial Sequence
  derived and/or modified CDS sequence (opt3) from HTNV(Chen4)__AB027101.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucucugcccccuguaagcugcuuccugauaccgcagcuguaagccugcacggagguccagccacaaaccgggacaauuugcgucaacgccagguugcgcucggcaacauggaaacuaaagaguccaaggccauuagacagcaugcagagucagcugggugcaguaugaucgaagauaucgagagcccgucuuccauuuggguguucgccggagcucccgacagguguccuccaaccugccuguuuauagccggcaucgcagaauuaggugccuucuuuucaauucugcaagauaugcggaauacaaucauggcuagcaaaaccgucgggacgagugaggaaaagcuccgaaagaaaucuuccuucuaucagagcuaccuucgcagaacucagucgaugggaauacagcuggaccaaaggauuaucguguuguuuaugguggcguggggcaaggaggcagucgauaacuuccggcuaggcgacgauauggaccccgagcugcgcacacucgcccagucucugaucgacguuaaagugaaggaaauuuccaaucaggagccucuuaaacuguga

SEQ ID NO: 5688 - RNA, 1290 nt, Artificial Sequence
  derived and/or modified CDS sequence (opt3) from HTNV(Hu)__AB027111.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguacgugucucuuccaaaugcucaaucgucaaugaaagccgaggaaaucacccccggacgcuaucgaacggcgauuugcggcuuguacccugcacagaucaaggccagacagaugauaagcccagucaugagugugauuggguuucuggcucuagccaaagauugguccgacaggaucgagcaguggcucucugaacccuguaagcugcuuccugauacugcagcuguaagccugcacggagguccagccaccaaccgggacuauuugcgucaacgccagguugcgcucggcaauauggagacaaaagaguccaaggccauuagacagcaugcagaagcugccgggugcucaaugaucgaggauaucgaaaguccgagcucuauuuggguguucgcuggagcccccgacagguccccuccaacuuguauguuuauagcaggcaucgaugagcugggugccuucuuuucaauuuuacaagacaugcggaacaccaucauggcuagcaaaacagucgggaccagugaagagaagcugcgaaagaaaucuuccuucuaccagagcuaccuccgcagaacgcagucgaugggaauacagcuugaucaaaggauuaucgugcuguuuaugguggcguggggcaaggaggcagucgacaauuuccacuugggcgaugacauggaccccgaacuacggacucuggcccagucucucaucgauauuaaaguuaaggagaucuccaaccaggaaccucugaaacuuuga

SEQ ID NO: 5689 - RNA, 1290 nt, Artificial Sequence
  derived and/or modified CDS sequence (opt3) from HTNV(HubeiHu02)__JQ665905.1__N
auggccaccauggaggaacugcagaaggagaucaacgcucacgaaggccaacucgugauugcaagacagaaagucagggacgccgagaagcaguacgaaaaagaucccgacgagcuuaauaagcggacacugacugaucgcgaggggguugcggcuagcauacaggccaaaaucgacgaauugaagcgacaauuagcagaucguauugccacgggaaagaaccuggguaaagagcaggacccuaccggcguggaaccaggggaucaucuaaaggagagauccaugcucucuuauggaaauguacuggaccuuaaccaccuggauaucgacgagccgacaggccagacugcugauugguugucaauugugaucuaccucaccaguuucgucgugcccauacugcugaaagcacucuauauguuaacaaccaggggucggcagacuacaaaggacaauaaagggacccgcaucagauuuaaggaugacagcuccuucgaagacguuaacggaauuaggaagccuaaacaucuguacgugucucuuccaaaugcccaaucgucaaugaaggcugaggauaucacgcccggccgguaucgcacugccauuugcggcuuguacccugcgcagaucaaagcacgacagaugauaagcccagucaugagugugauuggguuucuggcccuagcuaaggacugguccgauagaaucgaacaguggcucucugagcccuguaaacugcuuccugacaccgccgcaguaagccugcacggagguccagcuacaaacagggauuauuugcggcaacgucagguugcccucggcaauauggaaacuaaggaguccaaagcgauucgccagcaugccgagucagcagggugcaguaugaucgaagacaucgagagcccgucuuccauuuggguguucgcuggagcccccgauagauguccuccaaccugccuguuuauagcuggcaucgccgaauuaggugcauucuuuucaauucugcaagacaugaggaacacaaucauggccagcaagaccgucgggacgagugaggaaaagcuccggaaaaagucuuccuucuaccagagcuaccuucgacgcacucagucgaugggaauacagcuggaucaaagaauuaucguguuguuuaugguggcuuggggcaaagaggcggucgacaauuuccaccuaggcgaugacauggaccccgagcugaggacacucgcacagucucugaucgauguuaaggugaaagaaauuuccaaccaggagccucuuaagcuguga

SEQ ID NO: 5690 - RNA, 1290 nt, Artificial Sequence
  derived and/or modified CDS sequence (opt3) from HTNV(HV004)__JQ083395.1__N
auggccaccauggaggaacugcagaaggagaucaacgcucacgaaggccaacucgugauugcaagacagaaagucagggacgccgagaagcaguacgaaaaagaucccgacgagcuuaauaagcgggcgcugacagaucgcgaggggguugcugccagcauacaggcaaaaaucgacgaauugaagcgacaauuagccgaucguauugcuacuggaaagaaccuggguaaagagcaggacccuacgggcguggaaccaggggaucaucuaaaggagagauccaugcucucuuauggaaauguacuggaccuuaaccaccuggauaucgacgagccgaccggccagacagcagauugguugucaauugugaucuaccucaccaguuucgucgugcccauacugcugaaagcccucuauauguuaacuacaaggggucggcagaccacuaaggacaauaaagggacacgcaucagauuuaaggaugacagcuccuucgaagacguuaacggaauuaggaagccuaaacaucuguacgugucucuuccaaaugcucaaucgucaaugaaggccgaggaaaucacccccggccgguaucgcacggcgauuugcggcuuguacccugcacagaucaaagcccgacagaugauaagcccagucaugagugugauuggguuucuggcucuagccaaggauugguccgacagaaucgagcaguggcucucugaacccuguaaacugcuuccugauacugcagcuguaagccugcacggagguccagccaccaacagggacuauuugcggcaacgucagguugcgcucggcaauauggagacaaaggaguccaaagccauucgccagcaugcagaaucagcugggugcaguaugaucgaggauaucgaaagcccgucuuccauuuggguguucgccggagcucccgacagauguccuccaacuugccuguuuauagccggcaucgcagaguuaggugccuucuuuucaauucugcaagauaugaggaacaccaucauggcuagcaagacagucgggaccagugaagagaagcuccggaaaaagucuuccuucuaccagagcuaccuucgacgcacgcagucgaugggaauacagcuggaccaaagaauuaucguguuguuuaugguggcguggggcaaagaggcagucgauaauuuccaccuaggcgacgauauggaccccgaacugaggacucucgcccagucucugaucgacguuaaggugaaagagauuuccaaccaggaaccucuuaagcuguga

SEQ ID NO: 5691 - RNA, 1290 nt, Artificial Sequence
  derived and/or modified CDS sequence (opt3) from HTNV(Maaji-1)__AF321094.1__N
auggccaccauggaggaacugcagaaggagaucaacgcucacgaaggccaacucgugauugcaagacagaaagucagggacgccgagcggcaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccgucugcggcuuguacccugcgcagauuaaggcaagacagaugaucagcccagugaugaguguaauaggguuuauggcccuggcuaaagauugguccgagaggauugaacaguggcuaucugagcccuguaagcuccugccugacaccagcgccguuucccuucugggagguccagcaacaaacaaagauuauuugcggcaacgucagguggcucucggcaauauggagacuaaggaaucaaaagccauccgccagcaagcggaggccagugggugcagcaugauugaagacaucgagucuccguccucaaucugggucuucgcaggagcucccgauagauguccuccaaccugccuguuuauugccggcauggcugaauuaggugccuucuuuagcauacugcaggacaugaggaacacaaucauggcaaguaagaccguggggacgucugaggagaagcuccggaaaaaguccagcuucuaccagucguaccuucgacgcacucagucuaugggcauucaacuggaucagagaaucauaguguuguuuauggucgccuggggaaaagaagcuguugacaauuuccaccuaggcgaugacauggaucccgagcugaggacacucgcgcagucccugauugacgugaagguaaaagaaaucucaaaccaggagccucuuaagcuguga

SEQ ID NO: 5692 - RNA, 1290 nt, Artificial Sequence
  derived and/or modified CDS sequence (opt3) from HTNV(Maaji-2)__AF321095.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaacuucgguaaggagcaggacccuaccggcguagaaccaggggaucaucugaaagagagguccaugcuaucuuauggaaaugugcucgaccugaaccaccuugauaucgacgagccgacaggccagacugccgauuggcugucaauugucguguacuugaccaguuuuguugugcccauccuccugaaggcucuguauaugcucacaacccggggucgccagacuacaaaagacaauaaggggaccagaauaagguucaaagaugacagcuccuuugaagacgucaacggaauccggaagccuaagcauuuauacgugucucugccaaaugcacaaucgucaaugaaagccgaggaaauuacgcccggccgcuaucgaacugcuguaugcggccuuuacccugcccagaucaaggcgagacagaugauuagcccaguuaugagugugaucggguucuuggcacuggccaaagauugguccgacaggauagagcaguggcuaucugaacccuguaagcuccugccugauaccgcugccgucagccuucugggagguccagcaacaaaccgggacuauuugcgucaacgccagguggcucucggcaauauggagacuaaagaguccaaggccauuagacagcacgcggaagccgcagggugcucaaugaucgaggauauugaaaguccgagcucuaucuggguguuugcuggagcccccgacagguguccuccaaccugccuguucaucgcuggcauugccgaguuaggugcauuuuucuccauacugcaagauaugcggaacacaaucauggccucaaaaaccgucgggacgagcgaagagaagcuccgaaagaaaaguucuuuuuaccaguccuaccuucgcagaacucagcugaugggcauucaguuggaccaaaggaucauaguucuauucaugguggcuuggggaaaggaggcgguagauaauuuucaucugggcgacgauauggaccccgaacuccggacacuggcacagagccuuauugacgugaaagucaaggagaucucgaaccaggaaccucugaaauuguga

SEQ ID NO: 5693 - RNA, 1290 nt, Artificial Sequence
  derived and/or modified CDS sequence (opt3) from HTNV(N8)__DQ658415.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguaccuuucuuugccaaaugcccaaucgucaaugaaagcugaggaaaucacgcccggacgcuaucgaacugccauuugcggccuguacccugcgcagaucaaggcaagacagaugauaagcccagugaugagugucauuggguuucuagcccucgcuaaagauugguccgacaggaucgagcaguggcugucugaacccuguaaacuucugccugaugccgcagcugugagcuugcacggagguccagccaccaaccgggacuaucuccgucaacgccagguagcgcugggcaauauggagacaaaggaguccaaggccauuagacagcaugcagaaacugcugggugcucaaugaucgaugacaucgagaguccgagcucuauuuggguuuucgccggagcucccgauagguguccuccaaccugcuuauuuauagccggcaucgcagaacugggugccuucuuuuccauucuccaagacaugcggaacacaaucauggcuucaaaaaccguggggacgagcgaggaaaaacuucgaaagaagaguucuuucuaccaguccuaccugcgcagaacucagagcaugggaauacaguuggaucaaaggauuaucguccuauuuaugguggcguggggcaaggaggcaguggacaauuuccaccugggcgaugacauggaccccgagcuccggacacuggcccagucgcuuaucgaugucaaaguuaaggaaauuucuaaccaggagccucugaaauuguga

SEQ ID NO: 5694 - RNA, 1290 nt, Artificial Sequence
  derived and/or modified CDS sequence (opt3) from HTNV(Q32)__AB027097.1__N
auggccaccauggaggaacugcagagagagaucaacgcucacgaaggccaacucgugauugcaaggcuuaagguccgggacgccgagaaacccuacgaaaaggauccugacgagcugaauaugcgcacauugacugaucgagaggggguugcggcuagcauacaggccaaaaucgacgaauuaaagcgucagcuggcagauagaauugccacggguaaaaaccuaggaaaggagcaggacccaaccggcguggaaccgggggaucaucucaaggagagguccaugcugucuuauggaaauguacuugaccugaaccacuuggauaucgacgagcccacaggccaaacugcugauuggcucucaauugugaucuaccugaccaguuucgucgugccuauacugcucaaagcauuauauaugcugacaacccggggucgccagacuacaaaggacaauaaagggaccagaaucagguuuaaggaugacagcuccuucgaagacguuaacggcauucggaaaccaaagcaucuuuacgugucuuugcccaaugcccagucgucaaugaaggcugaggaaaucacgccuggacgcuaucgaacugccauuugcggccuguacccagcgcagaucaaagcaagacaaaugauaagccccgucaugagugugauuggguuucuagcccucgcuaaggauugguccgacaggaucgagcaguggcugucugaaccuuguaaacuucugccagauaccgccgcaguuagcuugcacggagguccggcuacaaaccgggacuaucuccgucagcgccagguagcccugggcaauauggagacuaaggaguccaaagcgauuagacaacaugccgaaucagcagggugcaguaugguggaggauaucgaaagccccucuuccaucugggucuucgcuggagccccugacagguguccaccuaccugcuuauuuauugcuggcauagccgagcugggugcauucuuuucaauccuccaggauaugcggaacacaauuauggccagcaagaccguggggacgagugaagagaaacuucgaaagaagucuuccuucuaccagagcuaccugcgcagaacucaaucgaugggaauccaguuggaccagaggauaauugugcuauuuauggucgcuuggggcaaagaggcgguugauaauuuccagcccggcgacgauauggacccagaacugcggacacucgcacaaucucugaucgacgugaagguaaaagagaucuccaaccaggaaccccuuaagcuguga

SEQ ID NO: 5695 - RNA, 1290 nt, Artificial Sequence
  derived and/or modified CDS sequence (opt3) from HTNV(SXHu2012B1)__KC844226.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguacgugucucuuccaaaugcucaaucgucaaugaaagccgaggaaaucacccccggacgcuaucgaacggcgauuugcggcuuguacccugcacagaucaaggccagacagaugauaagcccagucaugagugugauuggguuucuggcucuagccaaagauugguccgacaggaucgagcaguggcucucugaacccuguaagcugcuuccugauacugcagcuguaagccugcacggagguccagccaccaaccgggacuauuugcgucaacgccagguugcgcucggcaauauggagacaaaagaguccaaggccauuagacagcaugcagaaucagcugggugcaguaugguggaggauaucgaaagcccgucuuccaucugggucuucgccggagcucccgacagguguccuccaacuugccuguuuauugccggcauagcagaguuaggugccuucuuuucaauccugcaagauaugcggaacaccauuauggcuagcaaaacaguggggaccagugaagagaagcuccgaaagaaaucuuccuucuaccagagcuaccuucgcagaacgcagucgaugggaauccagcuggaccaaaggauaauuguguuguuuauggucgcguggggcaaggaggcaguugauaauuuccaccuaggcgacgauauggaccccgaacugcggacucucgcccagucucugaucgacgugaaaguaaaggagaucuccaaccaggaaccucuuaaacuguga

SEQ ID NO: 5696 - RNA, 1290 nt, Artificial Sequence
  derived and/or modified CDS sequence (opt3) from HTNV(TJJ16)__AY839871.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagagggguuggcugccagcauacaggcaaagaucgacgaauuaaaacgucaacuggccgauagaauugcuacuggaaagaaccuagguaaggagagggacccuacgggcguugaaccaggggaucaucucaaagagcgguccaugcugucuuauggaaaugugcuugaccugaaccacuuggauaucgacgagccgaccggccagacagcagauuggcucucaauuguaaucuaccugaccaguuucgugguccccauacugcucaaggccuuauauaugcugacuacacgcgguagacagaccacuaaagacaauaaggggacaaggauccgguuuaaagaugacagcuccuucgaagacgugaacggcauucgcaagccuaagcaucuuuacguuucuuugccaaaugcucagucgucaaugaaagccgaggaaaucacccccggacgauauagaacggcgauuugcggccuguacccugcacaaaucaaggccaggcagaugauaagcccagugaugagugucauuggguuucuagcucucgccaaagauugguccgaccggaucgagcaguggcugucugaacccuguaaacuucugccugauacugcagcugugagcuugcacggagguccagccaccaaccgugacuaucuccgccagagacaaguagcgcugggcaauauggagacaaaggaguccaaggccauuaggcagcaugcagaaucagcugggugcaguaugguugaggauaucgaaagcccgucuuccaucuggguguucgccggagcucccgaccgguguccuccaacuugcuuauacauugccggcauagcagagcugggugccuuuuucucaauccuccaggauaugcgaaacaccauuauggcuagcaaaacagucgggaccagugaagagaaacuucgcaagaagucuuccuuuuaccaaagcuaucugagaaggacgcagucgaugggaauccaguuggaccagcggauaauugugcuauucaugguggcguggggcaaggaggcagucgauaauuuucaccugggcgacgauauggaccccgaacuccgcacucuggcccaaucucuuaucgacguuaaagugaaggagaucuccaaccaggaaccucugaaauuguga

SEQ ID NO: 5697 - RNA, 1290 nt, Artificial Sequence
  derived and/or modified CDS sequence (opt3) from HTNV(WCL)__KM355414.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauuggagcgucaauuagcagauagaauugccacugguaaaaaccugggaaaggaacaggacccuacgggcguagagccaggggaucaucuaaaggagagguccaugcucucuuauggaaaugugcuggaccuuaaccaccuggauaucgacgaaccgaccggccagacagcugauugguugucaauugucguguaccucaccaguuucguugugcccauccugcugaaagcacucuauauguuaacuacacggggucgccagaccacuaaggacaauaaagggacaagaauaagguuuaaggaugacagcuccuucgaggacgucaacggaauccggaaaccuaagcaucuguacgugucucuuccaaaugcccaaucgucaaugaaggcugaagagauuacccccggccgcuaucgaacggccaucugcggcuuguacccugcgcagauuaaagcaagacagaugaucagcccaguaaugaguguuauaggguuucuggcccuagcuaaggauugguccgacaggauugaacaguggcucucugagcccuguaaacugcuuccugauacugccgcagugagccuguugggagguccagcuaccaaccgggacuaucuccgucaacgccaggucgcccugggcaauauggagacaaaggaauccaaagcgaucagacagcacgccgaggcagcugggugcucaaugauugaagauaucgagaguccgagcucuaucuggguguucgccggagcucccgacagguguccuccaacuugcuuauuuauugccggcauagcagaacugggugccuucuuuuccauccuccaagauaugcggaacaccauuauggcuucaaagacaguggggaccagcgaggagaaacuucgaaagaagaguucuuucuaccaguccuaccugcgcagaacgcagagcaugggaauccaguuggaccaaaggauaauuguccuauuuaugguugcguggggcaaagaagcaguggauaauuuccaucugggcgacgauauggaccccgagcuccggacucuggcccagucgcuuaucgacguaaaggugaaagaaaucucuaaccaggagccucugaaguuguga

SEQ ID NO: 5698 - RNA, 1290 nt, Artificial Sequence
  derived and/or modified CDS sequence (opt3) from HTNV(YN509)__GU329991.1__N
auggccaccauggaggaacugcagaaggagaucaacgcucacgaaggccaacucauuauagcaaaacagaaggugaaagacgccgagaagcaguacgaaaaagaucccgacgagcuuaauaagagagcgcugacagauagggagggggucgcugccagcauccaggcaaagauugacgaauugaaacggcaauuagccgaucgcaucgcuacuggaaagaaccugggucaggaccgagauccuacgggcguugagccaggggaccaucuaaaagaacguuccaugcucucuuauggaaauauucuggaucuuaaccaccuggacaucgaugagccgaccggccagacagcagacugguugucaauaaucguguaccucaccaguuucguagugcccauucugcugaaggcccucuauauguuaacuacaagagguaggcagaccgcuaaagauaauaaggggacucggauccgcuuuaaggacgacagcuccuucgaggaugucaacggaauuagaaaaccuaagcaucuguacgugucuaugccaaaugcccaaucgucaaugaaagcggaagagaucacacccggcagguaucggaccgcaguuugcggccuuuacccugcccagauaaaggcucgccagauggugagcccagucaugagugugauuggguuuauggccuuggcaaaagacuggacggaucgaaucgaaaacuggcugggagagcccuguaagcuacucccugacacuuccucuguaauucugcuugguggcccagcuaccaauagagauuauaucaggcagcggcaaguugcccuggggaacauggaaacaaaagaggcgaaggccgugcgucagcacgcagagagcgcuggaugcuccaugaucgacaauauugauucaccgaguagcauaugggucuucgccggcgcucccgaccgcuguccuccaacuugcuuguuuguggccggucucgcagaacugggggccuucuuuucuaucuuacaggauaugagaaacaccauuauggcuuccaagacagugggaaccucagaggagaaaaugaggaagaaaagcaguuucuaccaaucuuaccugcggcgaacgcaguccaugggcauccagcucgaccagcgcauaauuguccuuuuuaugguugcguggggcaaggaagcaguggauaauuuccaucugggggacgacauggaucccgaauugagaaaccuagcccaaagccugaucgaccagaaaguaaaggagaucucgaaucaggagccucucaagcuguga

SEQ ID NO: 5699 - RNA, 1290 nt, Artificial Sequence
  derived and/or modified CDS sequence (opt3) from HTNV(YU62)__AY748309.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagagggguuggcugccagcauacaggcaaagaucgacgaauuaaaacgucaacuggccgauagaauugcuacuggaaagaaccuagguaaggagcaggacccuacgggcguugaaccaggggaucaucucaaagagagguccaugcugucuuauggaaaugugcuugaccugaaccacuuggauaucgacgagccgaccggccagacagcagauuggcucucaauuguaaucuaccugaccaguuucgugguccccauacugcucaaggccuuauauaugcugacuacacggggucgccagaccacuaaagacaauaaggggacaagaaucagguuuaaagaugacagcuccuucgaagacgugaacggcauucggaagccuaagcaucuuuacguuucuuugccaaaugcucaaucgucaaugaaagccgaggaaaucacccccggacgcuaucgaacggcgauuugcggccuguacccugcacagaucaaggccagacagaugauaagcccagugaugagugucauuggguuucuagcucucgccaaagauugguccgacaggaucgagcaguggcugucugaacccuguaaacuucugccugauacugcagcugugagcuugcacggagguccagccaccaaccgggacuaucuccgucaacgccagguagcgcugggcaauauggagacaaaggaguccaaggccauuagacagcaugcagaaucagcugggugcaguaugguugaggauaucgaaagcccgucuuccaucuggguguucgccggagcucccgacagguguccuccaacuugcuuauuuauugccggcauagcagagcugggugccuucuuuucaauccuccaagauaugcggaacaccauuauggcuagcaaaacagucgggaccagugaagagaaacuucgaaagaagucuuccuucuaccagagcuaccugcgcagaacgcagucgaugggaauccaguuggaccaaaggauaauugugcuauuuaugguggcguggggcaaggaggcagucgauaauuuccaccugggcgacgauauggaccccgaacuccggacucuggcccagucucuuaucgacguuaaagugaaggagaucuccaaccaggaaccucugaaauuguga

SEQ ID NO: 5700 - RNA, 1290 nt, Artificial Sequence
  derived and/or modified CDS sequence (opt3) from HTNV(ZLS6-11)__FJ753396.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacauuaacggaauccggaagccuaagcaucuguacguuucucuuccaaaugcucaaucgucaaugaaagccgaggaaauuacccccggccgcuaucgaacggcgaucugcggcuuguacccugcacagauaaaggccagacagaugauuagcccagugaugagugucaucggguuucuggcucuagccaaagauugguccgacaggauugagcaguggcucucugaacccuguaagcugcuuccugauacugcagcugugagccugcacggagguccagccaccaaccgggacuauuugcgucaacgccagguagcgcucggcaauauggagacaaaagaguccaaggccaucagacagcaugcagaaacugcugggugcucaaugaucgaggauauugaaaguccgagcucuauauggguuuucgccggagcucccgacagguguccuccaaccugccuguuuaucgccggcauugcagaguuaggugccuucuuuuccauccugcaagauaugcggaacacaauaauggcuucaaaaaccguggggacgagcgaagagaagcuccgaaagaaaaguucuuucuaccaguccuaccuucgcagaacucagagcaugggcauucagcuggaccaaaggaucaucgucuuguuuaugguggcguggggaaaggaggcaguggauaauuuccaccuaggcgacgauauggaccccgaacugcggacacucgcccagucgcugauugacgucaaaguuaaggagaucucuaaccaggaaccucuuaaacuguga

SEQ ID NO: 5701 - RNA, 1290 nt, Artificial Sequence
  derived and/or modified CDS sequence (opt3) from HTNV__AB027523.1__N
auggccaccauggaggaacugcagaaggagaucaacgcucacgaaggccaacucauuauagcaaaacagaaggugaaagacgccgagaagcaguacgaaaaagaucccgacgagcuuaauaagagagcgcugacagauagggagggggucagcgcuuccauccaggccaagauugacgaauugaaacggcaauuagcagaucgcaucgccacuggaaagaaccugggucaggaccgagauccuacgggcguugagccaggggaccaucuaaaagaacguucuaugcucucauauggaaauauucuggaucuuaaccaccuggacaucgaugagccgaccggccagacagcugacugguugaguauaaucguguaccucacuagcuucguagugcccauucugcugaaggcacucuauauguuaaccacaagagguaggcagaccgccaaagauaauaaggggacucggauccgcuuuaaggacgacuccucuuucgaggaugucaacggaauuagaaaaccuaagcaucuguacgugucgaugccaaaugcucaaucaagcaugaaagccgaagagaucacacccggcggcuauaggaccgcgguuugcgggcuuuuuccugcacagauaaaggcccggcagauggugaguccagucauguccgugauuggauucauggcuuuggccaaagacuggacggaucgcaucgaaucuuggcugggugagcccuguaagcuacucccugacacuagcgcaguaucccugcuuggcgggccagcuaccaaccgagauuacauuagacagaggcaaguugcccugggaaauauggaaacaaaagaggcgaaggccgugcggcagcacgcagagucagcuggcugcaguaugaucgacaacaucgauagcccgucuuccauuugggucuuugccggugcucccgaccguuguccuccaacuugcuuguucauagccgggaucgcagaacucggagccuuuuucucaauucugcaggauaugcgcaauaccaucauggcuagcaagacagugggcaccagugaggagaaaaugagaaagaaaucuuccuuuuaucaaagcuacuuaaggcggacgcagucgaugggcauacagcuggaccagcgaauuaucguccucuucaugguggcgugggggaaggaagcagccgauaacuuucaacauggagacgacauggaucccgaacuucgcacucuggcucagucuuugaucgaccagaaaguuaaggagauuuccaaucaggagccucuaaagcuguga

SEQ ID NO: 5702 - RNA, 1293 nt, Artificial Sequence
  derived and/or modified CDS sequence (opt3) from HTNV__D25530.1__N
augauggccaccauggaggaacugcagagagagaucaacgcucacgaaggccaacucgugauugcaaggcagaagguccgggacgccgagaaacaguacgaaaaggaucccgacgagcuuaauaaacgcgcgcugacaaaccgagaggggguugcugugagcauacaggccaagaucgaugaauugaaaaugcaauuagcagaccguauugccacuggaaagaaucuggguaaggagcaggauccuacgggcguagaaccaggggaccaucuaaaagagagauccaugcucucuuauggaaacgugcuggaucuuaaucaccuggacaucgaugagccgaccggccagacagcugacugguugucaauuaucgucuaccucaccaguuucgugguucccauacugcugaaggcacucuauauguuaacuacaaggggucggcagaccacuaaagauaacaaggggacacgcaucagauuuaaagacgauagcuccuucgaagacgugaauggaauuaggaagccuaagcaucuguacgucucucuuccaaacgcccaaucgucaaugaaagcugaggaaaucacccccggccgguaucgcacggccgugugcggcuuguacccugcgcagauuaaggcacgacagaugaucagcccaguaaugaguguuauaggguuucuggcccuagcuaaagacugguccgauagaauugagcaguggcucaucgaacccuguaagcugcuuccugacacugccgcagugucucuguugggagguccagcuaccaauagggauuaucuccggcaacgucaggucgcccugggcaacauggagacaaaagagagcaaggcgauucgccagcacgccgaagcagcugggugcuccaugaucgaggacaucgaaucaccgaguagcauuuggguguucgccggagcucccgauagauguccuccaacuugcuuauuuauagccggcaucgcagagcugggugccuucuuuucuauucuccaagacaugaggaauaccaucauggcuuccaaaacaguggggaccucagaagagaagcugcggaagaaaagcaguuucuaccagucuuaccuucgacgcacgcaguccaugggaauacaguuggaucaaagaauuaucguccuauuuaugguugcguggggcaaggaggcaguggacaacuuccaucugggcgaugacauggaucccgaacucaggacucuggcccagagccuuaucgacguaaaagugaaggagauuucgaaucaggaaccucugaaauuguga

SEQ ID NO: 5703 - RNA, 1290 nt, Artificial Sequence
  derived and/or modified CDS sequence (opt3) from HTNV__M14626.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaaccuggguaaggagcaggacccuaccggcguagaaccaggggaucaucuaaaagagagguccaugcucucuuauggaaaugugcuggaccuuaaccaccuggauaucgacgagccgacaggccagacugccgauugguugucaauuaucgucuaccucaccaguuucgugguucccauacugcugaaggcucucuauauguuaacaacccggggucgccagacuacaaaagacaauaaggggaccagaaucagguuuaaagaugacagcuccuucgaagacgugaacggcauucggaagccuaagcaucuguacgucucucuuccaaaugcacaaucgucaaugaaagccgaggaaaucacgcccggacgcuaucgaacugcugugugcggcuuguacccugcccagauuaaggcgagacagaugaucagcccaguaaugaguguuauaggguuucuggcacuagccaaagauugguccgacaggauugagcaguggcucaucgaacccuguaagcugcuuccugauaccgcugccgugucucuguugggagguccagcaacaaaccgggacuaucuccgucaacgccaggucgcucugggcaauauggagacuaaagagagcaaggccauuagacagcacgcggaagccgcagggugcuccaugaucgaggauaucgaaucaccgaguagcauuuggguguucgcuggagcccccgacagguguccuccaaccugcuuauuuauagcuggcaucgccgagcugggugcauucuuuucuauucuccaagauaugcggaacacaaucauggccuccaaaaccguggggacgucagaagagaagcugcgaaagaaaagcaguuucuaccagucuuaccuucgcagaacucaguccaugggaauacaguugggccaaaggauuaucguccuauuuaugguugcuuggggcaaggaggcgguggacaauuuccaucugggggaugacauggaucccgaacuccggacacuggcacagagccuuaucgacguaaaagugaaggagauuucgaaccaggaaccucugaaauuguga

SEQ ID NO: 5704 - RNA, 1290 nt, Artificial Sequence
  derived and/or modified CDS sequence (opt3) from HTNV__X95077.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaaccuggguaaggagcaggacccuaccggcguagaaccaggggaucaucuaaaagagagguccaugcucucuuauggaaaugugcuggaccuuaaccaccuggauaucgacgagccgacaggccagacugccgauugguugucaauugucguguaccucaccaguuucguugugcccacacugcugaaggcucucuauauguuaaccacucggggucgccagacaaccaaagacaauaaggggacgagaaucagguuuaaagaugacagcuccuucgaagacgucaacggaauacggaagccuaagcaucuguacgugucucuuccaaaugcacaaucgucaaugaaagccgaggaaaucacucccggccgcuaucgaaccgcuguaugcggcuuguacccugcccagauuaaggcgagacagaugaucagcccaguuaugagugugauuggguuucuggcacuagccaaagauugguccgacaggaucgagcaguggcucucugaacccuguaagcugcuuccugauacaacugcugucagccuguugggagguccagccaccaaccgggacuaucuccgucaacgccagguggcacugggcaauauggagacaaaagaguccaaggcuauaagacagcacgccgaagcggccgggugcucaaugauugaggauaucgaaaguccgagcucuauuuggguguucgcaggagcucccgacagguguccuccaaccugcuuauuuaucgccggcaucgcugagcugggugccuucuuuuccauucuccaagauaugcggaacacgauaauggcaucaaaaacugucgggacaagcgaagagaaacuucgaaagaagaguucuuucuaccaguccuaccugcgcagaacccagagcaugggaauccaguuggaccaaaggauuaucguucuauuuaugguggccuggggcaaggaggcuguagauaauuuccaucugggcgacgauauggaccccgaacuccggacucuggcgcagucgcuuauagacgugaaagucaaggagauuucuaaccaggaaccucugaaauuguga

SEQ ID NO: 5705 - RNA, 1290 nt, Artificial Sequence
  derived and/or modified CDS sequence (opt3) from HTNV(CGAa1011)__EF990913.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuggaugugucucuuccaaaugcccaaucgucaaugaaagcugaggaaaucacgcccggacgcuaccgaacugccauuugcggcuuguauccugcgcagaucaaggcaagacagaugauaagcccagucaugagugugauuggguuucuggcccuagcuaaagacugguccgauaggaucgagcaguggcucggagaacccuguaagcugcuuccugacaccgccgcaguaucucuguuggguggcccagcuacaaaccgggauuaccuccgucaacgccagguugcccuggggaauauggagacuaaagagagcaaggcgauuagacagcacgccgaaaccgcaggaugcuccaugaucgaggacaucgaaucaccgaguagcauuuggguguucgcuggcgcccccgauagguguccuccaacaugcuuauuuauagcugguaucgccgagcugggggcauucuuuucuguccuccaagacaugcggaacaccauuauggccuccaaaacggugggaacuucagaagagaagcugcgaaagaaaagcaguuucuaucagucuuaccuuggccgcacacaguccaugggcauccaguuggaucaaagaauaauugugcuauuuauggucgcuugggggaaggaggcgguugacaauuuccaucugggagaugacguggaccccgaacucaggacccuggcacagagccuuaucgauguaaaagugaaggagaucucggaccaggaaccucugaaauuguga

SEQ ID NO: 5706 - RNA, 1290 nt, Artificial Sequence
  derived and/or modified CDS sequence (opt3) from HTNV(CGAa1015)__EF990912.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuggaugugucucuuccaaaugcccaaucgucaaugaaagcugaggaaaucacgcccggacgcuaccgaacugccauuugcggcuuguauccugcgcagaucaaggcaagacagaugauaagcccagucaugagugugauuggguaccuggcccuagcuaaagacugguccgauaggaucgagcaguggcucggagaacccuguaagcugcuuccugacaccgccgcaguaucucuguuggguggcccagcuacaaaccgggauuaucuccgucaacgccagguugcccuggggaauauggagacuaaagagagcaaggcgauuagacagcacgccgaaaccgcaggaugcuccaugaucgaggacaucgaaucaccgaguagcauuuggguguuugcuggcgcccccgauagguguccuccaacaugcuuauucauagcugguaucgccgagcugggggcauuuauuucuguccuccaagacaugcggaacaccaucauggccuccaaaacggugggaacuucagaagagaagcugcgaaagaaaagcaguuucuaccagucuuaccuuggccgcacacaguccaugggcauacaguuggaucaaagaauuaucgugcuauuuauggucgcuugggggaaggaggcgguugacaauuuccaucugggagaugacguggaccccgaacucaggacccuggcacagagccuuaucgauguaaaagugaaggagauuucggaccaggaaccucugaaauuguga

SEQ ID NO: 5707 - RNA, 1290 nt, Artificial Sequence
  derived and/or modified CDS sequence (opt3) from HTNV(CGAa2)__EU092219.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcuaaggagaucacgcccggacgcuaucgaacugccauuugcggcuuguacccugcgcagaucaaagcaagacagaugauaagcccagucaugagugugauuggguuucuggcccuagcuaaggauugguccgacaggaucgaacaguggcucucugagcccuguaaacugcuuccugauaccgccgcaguaagccugcacggagguccagcuacaaaccgggacuauuugcgucaacgccagguugcccucggcaauauggaaccgaaggaguccaaagcgauuagacagcaugccgagucagcagggugcaguaugguggaagauaucgagagccccucuuccaucugggucuucgcuggagccccugacagguguccacccacuugccuguuuauugcuggcauagccgaauuaggugcauucuuuucaauccugcaagauaugcggaacaccauuauggccagcaagacaguggggaccagugaggaaaagcuccgcaaaaagucuuccuucuaccagagcuaccuucgaagaacgcagucgaugggaauccagcuggaccaaaggauaauuguguuguuuauggucgcuuggggcaaagaggcgguugauaauuuccaccuaggcgacgauauggacccugagcugcggacucucgcacagucucugaucgacgugaagguaaaagaaaucuccaaccaggagccacuuaagcuguga

SEQ ID NO: 5708 - RNA, 1290 nt, Artificial Sequence
  derived and/or modified CDS sequence (opt3) from HTNV(CGAa31MP7)__EF990911.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucucugaacccuguaagcugcuuccugauaccgccgcaguaagccugcacggagguccagcuacaaaccgggacuauuugcgucaacgccagguugcccucggcaauauggagacuaaagaguccaaggcgauuagacagcaugccgaaucagcagggugcaguaugguggaggauaucgaaagcccgucuuccaucugggucuucgcuggagcccccgacagguguccuccaaccugccuguuuauugcuggcauagccgaguuaggugcauucuuuucaauccugcaagauaugcggaacacaauuauggccagcaaaaccguggggacgagugaagagaagcuccgaaagaaaucuuccuucuaccagagcuaccuucgcagaacucagucgaugggaauccagcuggaccaaaggauaauuguguuguuuauggucgcuuggggcaaggaggcgguugauaauuuccaccuaggcgacgauauggaccccgaacugcggacacucgcacagucucugaucgacgugaaaguaaaggagaucuccaaccaggaaccucuuaaacuguga

SEQ ID NO: 5709 - RNA, 1290 nt, Artificial Sequence
  derived and/or modified CDS sequence (opt3) from HTNV(CGAa31P9)__EF990910.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucucugaacccuguaagcugcuuccugauaccgccgcaguaagccugcacggagguccagcuacaaaccgggacuauuugcgucaacgccagguugcccucggcaauauggagacuaaagaguccaaggcgauuagacagcaugccgaaucagcagggugcaguaugguggaggauaucgaaagcccgucuuccaucugggucuucgcuggagcccccgacagguguccuccaaccugccuguuuauugcugagauagccgaauuaggcgcauucuuuucaauccugcaagauaugcggaacacaauuauggccagcaaaaccguggguacgagugaggagaagcuccgaaagaaaucuuccuucuaccagagcuaccuucgcagaacucagucgauggggauccagcuggaccaaaggauaauuguguuguuuauggucgcuuggggaaaggaagcgguugauaauuuccaccuaggcgacgauauggaccccgagcugcggacacucgcacagucucugaucgacgugaaaguaaaggaaaucuccaaccaggagccucuuaaacuguga

SEQ ID NO: 5710 - RNA, 1290 nt, Artificial Sequence
  derived and/or modified CDS sequence (opt3) from HTNV(CGAa4MP9)__EF990915.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucggagaacccuguaagcugcuuccugauaccgccgcaguaucucuguuggguggcccagcuacaaaccgggacuaucuccgucaacgccagguugcccuggggaauauggagacuaaagagagcaaggcgauuagacagcacgccgaaaccgcaggaugcuccaugaucgaggauaucgaaucaccgaguagcauuuggguguucgcuggcgcccccgacagguguccuccaacaugcuuauuuauagcugguaucgccgagcugggggcauucuuuucuguccuccaagauaugcggaacaccauuauggccuccaaaacggugggaacuucagaagagaagcugcgaaagaaaagcaguuucuaccagucuuaccuucgcagaacacaguccaugggcauccaguuggaccaaaggauaauugugcuauuuauggucgcuuggggcaaggaggcgguugauaauuuccaucugggggacgauauggaccccgaacuccggacccuggcacagagccuuaucgacgugaaaguaaaggagaucucgaaccaggaaccucugaaauuguga

SEQ ID NO: 5711 - RNA, 1290 nt, Artificial Sequence
  derived and/or modified CDS sequence (opt3) from HTNV(CGAa75)__EU092220.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguagcgucgugcccauacugcugaaggcacucuauauguuaacaacccggggucgccagacuacaaaagacaauaaggggaccagaaucagguucaaagaugacuccucuuuugaagacguuaacggcauucggaagccuaagcaucuguacgugucgcuuccaaaugcccaaucaagcaugaaagcugaggaaaucacgcccggacgcuaucgaacugccauuugcggcuuguacccugcgcagaucaaggcaagacagaugauaaguccagucaugaacgugauuggguuccuggcccuagcuaaagauugguccgacaggaucgagcaguggcucucugaacccuguaagcugcuuccugauaccgccgcaguaagccugcacggagguccagcuacaaaucgggacuauuugcgucaacgccagguugcccucggcaacauggagacuaaagaguccaaggcgauuagacagcaugccgaaucagcagggugcaguaugguggaggauaucgaaagcccgucuuccaucugggucuuugcuggagcccccgacagguguccuccaaccugccuguucauugcuggcauagccgaguuaggugcauuuuucucaauccugcaagauaugcggaauacaauuauggccagcaaaaccguggggacgagugaagagaagcuccgaaagaaaucuuccuuuuaccagagcuaccuucgcagaacucagucgaugggaauccagcuggaccaaaggauaauuguguuguucauggucgcuuggggcaaggaggcgguugauaacuuucaccuaggcgacgauauggaccccgaacugcggacacucgcacagucucugaucgacgugaaaguaaaggagaucuccaaucaggaaccucuuaaacuguga

SEQ ID NO: 5712 - RNA, 1290 nt, Artificial Sequence
  derived and/or modified CDS sequence (opt3) from HTNV(CGHu1)__EU092218.1__N
auggccaccauggaggaacugcagagagagaucaacgcucacgaaggccaacucgugauugcaaggcagaagguccgggacgccgagaaacaguacgaaaaggauagcgacgagcuuaauaaacgcacacugacugaucgagaggggguugcgguguccauacaggcuaagaucgacgaauugaaacgucaauuagccgauagaauugcaacgggaaagaaccuggguaaggagcaggaccccaccggcguagaaccuggggaucaucuaaaagagaggucuaugcucucauauggaaaugugcuggaccuuaaccaccuggauaucgacgagccaacaggccagacugccgauugguugaguauugucguguaccucaccagccugguugugccgauccugcucaaggcuuuauauaugcugacaaccaaaggucggcagacuacaaaggacaauaaagggacccgcauaagauucaaggaugacuccucuuuugaagacgucaacggaaucaggaagcccaaacaucuuuacgugucguugcugaaugcacaaucaagcaugaaggccgaggaaauuacgccuggccgguaucgcacugcuaucugcggcccauaccccgcccagauuaaagcgcgacagaugaucaguccuguaauguccguuauaggguuccuagcacucgccaaggauuggucugacagaauugagcaguggcugagcgaaccauguaaacuucugcccgauaccgcugccguguccuugcucggagguccugcaacaaacagggacuaucugcggcaacgucaggucgcuuuaggcaauauggagacuaaggagucaaaagccauccgccagcacgcggaagccgcagggugcaguaugauugaggauaucgaaagcccaucuuccaucugggugucagcuggagccccggacagaugucccccuaccugccuguuuauugcuggcauagccgagcucggugcauucuuuagcauccuucaagauaugaggaacacaauuauggccaguaagaccguggggacgucugaagagaagcugcggaaaaaguccagcuucuaccagucguacuugcgacgcacucagucuaugggaauccagcuagaccaaagaauaauuguccuguuuaugguugcuuggggcaaagaggcgguggauaauuuccaucucggcgacgauauggacccagaacugaggacacuugcacagucccugaucgacguaaaggugaaagagaucucaaaccaggaacccuugaagcucuga

SEQ ID NO: 5713 - RNA, 1290 nt, Artificial Sequence
  derived and/or modified CDS sequence (opt3) from HTNV(CGHu2)__EU363813.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccagucuggucgugcccauacugcucaaggcauuauauaugcugacaacccggggucgccagacuacaaaagacaauaaggggaccagaaucagguucaaagaugacagcuccuuugaagacguuaacggcauucggaagccuaagcaucuuuacgugucuuugccaaaugcccaaucgucaaugaaagcugaggaaaucacgcccggacgcuaucgaacugccauuugcggccuguacccugcgcagaucaaggcaagacagaugauaagcccagucaugagugugauuggguuccuagcccucgcuaaagauugguccgacaggaucgagcaguggcugucugaacccuguaaguugcugccugauaccgccgcaguaagccuucacggagguccagcuacaaaccgggacuaucuccgucaacgccagguugcccugggcaauauggagacuaaagaguccaaggcgauuagacagcaugccgaaucagcagggugcaguaugguggaggauaucgaaagcccgucuuccaucugggucuuugcuggagcccccgacagguguccuccaaccugcuuauucauugcuggcauagccgagcugggugcauuuuucucaaucagccaagauaugcggaacacaauuauggccaguaaaaccguggggacgucugaagagaagcuccgaaagaaauccagcuuuuaccagucguaccuucgcagaacucagucuaugggaauccagcuggaccaaaggauaauuguguuguucauggucgcuuggggcaaggaggcgguugauaauuuucaccuaggcgacgauauggaccccgaacugcggacacucgcacagucccugaucgacgugaaaguaaaggagaucucaaaccaggaaccucuuaaacuguga

SEQ ID NO: 5714 - RNA, 1290 nt, Artificial Sequence
  derived and/or modified CDS sequence (opt3) from HTNV(CGHu3612)__EF990909.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagagggguuggcugccagcauacaggcaaagaucgacgaauuaaaacgucaacuggccgauagaguugcuacuggaaagaaccuagguaaggagcaggacccuacgggcguggaaccaggggaucaucucaaagagagguccaugcugucuuauggaaauguacuugaccugaaccacuuggauauugacgagccgaccggccagacagcagauuggcucucaaucgugauuuaccugacuagcuucgucgugcccauccugcucaaggccuuauauaugcugaccacacggggucgccagaccacuaaagacaauaaggggacaagaauaagguuuaaagaugacagcuccuucgaagacguuaacggaauccggaagccuaagcaucuuuacgugucuuugccaaaugcucaaucgucaaugaaagccgaggaaauuacccccggccgcuaucgaacggcgaucugcggccuguacccugcacagauuaaggccagacagaugaucagcccagucaugagugugauaggguuucuagcucucgccaaagauugguccgacaggauugagcaguggcugucugaacccuguaaacuucugccugauacugcagcuguaaguuugcacggagguccagccaccaaccgggacuaucuccgucaacgccagguugcgcugggcaauauggagacaaaggaguccaaggccaucagacagcaugcagaaucagcugggugcaguaugguggaggauauugaaagcccgucuuccaucugggucuucgccggagcucccgacagguguccuccaacuugcuuauuuaucgccggcauugcagagcugggugccuucuuuucaauacuccaagauaugcggaacaccaucauggcuagcaaaacaguggggaccagugaagagaaacuucgaaagaagucuuccuucuaccagagcuaccugcgcagaacgcagucgaugggcauucaguuggaccaaaggaucauagugcuauuuauggucgcguggggaaaggaggcaguugauaauuuccaccugggcgacgauauggaccccgaacuccggacucuggcccagucucuuauugacgugaaaguacgcgagaucuccaaccaggaaccucugaaguuguga

SEQ ID NO: 5715 - RNA, 1290 nt, Artificial Sequence
  derived and/or modified CDS sequence (opt3) from HTNV(CGRn15)__EU363810.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugacgcuuccaaaugcccaaucuucgaugaaagcugaggaaaucacucccggacgcuaucgaaccgccauuugcggcuuguacccugcgcagaucaaggcaagacagaugauaucaccagucaugagcgugauuggguuucuggcccuagcuaaagauuggagugacaggaucgagcaguggcucuccgaacccuguaagcugcuuccugauacagccgcaguaucucugcacggagguccagcuacuaaccgggacuauuugcgucaacgccagguugcccucggcaauauggagaccaaagagagcaaggcgauuagacagcaugccgaauccgcagggugcucaaugguggaggauaucgaaaguccgagcucuaucugggucuucgcuggagcccccgacagguguccuccaacaugccuguuuauugcuggcauagccgaguuaggugcauucuuuuccauccugcaagauaugcggaacaccauuauggccucaaaaacgguggggacuagcgaagagaagcuccgaaagaaaaguucuuucuaccaguccuaccuucgcagaacacagagcaugggaauccagcuggaccaaaggauaauuguguuguuuauggucgcuuggggcaaggaggcgguugauaauuuccaccuaggcgacgauauggaccccgaacugcggacccucgcacagucgcugaucgacgugaaaguaaaggagaucucuaaccaggaaccucuuaaacuguga

SEQ ID NO: 5716 - RNA, 1290 nt, Artificial Sequence
  derived and/or modified CDS sequence (opt3) from HTNV(CGRn2616)__EU363811.1__N
auggccaccauggaggaacugcagagagagaucaacgcucacgaaggccaacucgugauugcaaggcagaagguccgggacgccgggaaacaguacgagaaggaucccgacgaacuuaauaaacgcacacugacugaucgagagggaguugcggcuagcauacaggccaagaucgacgaguugaaacgucaauuagcagauagaauugccacggguaagaaccugggcaaggaacaggacccuaccgggguggagccaggagaucaucuaaaagaaagguccaugcucucuuauggcaauguacuggaccuuaaccaccuggauaucgacgagccgacaggucagacugcugauugguugucaauugugaucuaccucaccaguuucgucgugcccauacugcugaaggcacucuauauguuaacaacccgggggcgccagacuacaaaagacaauaagggaaccagaaucagguuuaaagaugacagcuccuucgaggacguuaacggcauucggaagccuaagcaucuguacgugucucuuccaaaugcccaaucgucaaugaaagcugaagagaucacgcccggccgcuaucgaacugccauuugcggguuguacccugcgcagaucaaggcaagacagaugauaagcccagucaugagugugauuggauuucuggcccuagcuaaagauugguccgacaggaucgaacaguggcucucugagcccuguaagcugcuuccugauaccgccgcaguaagccugcacgguggcccagcuacaaaccgggacuauuugcgucaacgccagguugcccucgggaauauggaaacuaaagaguccaaggcgauuagacagcaugccgagucagcaggaugcaguaugguggaagauaucggcagcccgucuuccaucugggucuucgcuggugcccccgacagguguccuccaaccugccuguuuauugcugggauagccgaguuaggagcauucuuuucaauccugcaagauaugcggaacacaauuauggccagcaaaaccgugggcacgagugaagagaagcuccgaaagaaaucuuccuucuaccagagcuaccuucgcagaacucagucgaugggcauccagcuggaccaaaggauaauuguguuguuuauggucgcuugggggaaggaagcgguugauaauuuccaccuaggagacgauauggaccccgagcugcggacacucgcacagucucugaucgacguggagguaaaagaaaucuccaaccaggagccucuuaagcuguga

SEQ ID NO: 5717 - RNA, 1290 nt, Artificial Sequence
  derived and/or modified CDS sequence (opt3) from HTNV(CGRn53)__EF990907.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguacgugucucuuccaaaugcucaaucgucaaugaaagccgaggaaaucacccccggacgcuaucgaacggcgauuugcggcuuguacccugcacagaucaaggccagacagaugauaagcccagucaugagugugauuggguuucuggcucuagccaaagauugguccgacaggaucgagcaguggcucucugaacccuguaagcugcuuccugauacugcagcuguaagccugcacggagguccagccaccaaccgggacuauuugcgucaacgccagguugcgcucggcaauauggagacaaaagaguccaaggccauuagacagcaugcagaagcugccgggugcucaaugaucgaggauaucgaaaguccgagcucuauuuggguguucgcuggagcccccgacagguguccuccaacuugccuguuuauagcaggcaucgccgaguuaggugcuuucuuuuccauucugcaagauaugcggaacaccaucauggcgucaaaaacagucgggaccagcgaagagaagcuccgaaagaaaaguucuuucuaccaguccuaccuucgcagaacgcagagcaugggaauacagcuggaccaaaggauuaucguguuguuuaugguggcauggggcaaggaggccgucgauaauuuccaccuaggcgacgauauggaccccgaacugcggacucucgcucagucgcugaucgacguuaaagugaaggagauuucuaaccaggaaccucuuaaacuguga

SEQ ID NO: 5718 - RNA, 1290 nt, Artificial Sequence
  derived and/or modified CDS sequence (opt3) from HTNV(CGRn5310)__EF990906.1__N
auggccaccauggaggaacugcagagagagaucaacgcucacgaaggccaacucgugauugcaaggcagaagguccgggacgccgagaaacaguacgaaaaggaucccgacgagccuaauaaacgcgcgcuuacagaucgagaggggguugcugccagcauacaggcaaagaucgacgaacugaaacgucaauuggccgauagaauugcuacuggaaagaacuuagguaaggagcaggacccaacgggcguggaaccgggggaucaucugaaagagagguccaugcuaucuuauggaaauguacucgaccugaaccaccuugauaucgacgagcccaccggccagacagcagauuggcugucaauugugaucuacuugaccaguuucgucgugccuauacuccugaaggcccuguauaugcucacuacacggggucgccagaccacuaaagacaauaaggggacaagaaucagguuuaaagaugacagcuccuucgaagacguuaacggcauucggaagccaaagcauuuauacgugucucugcccaaugcucaaucgucaaugaaagccgaggaaaucaccccuggacgcuaucgaacggcgauuugcggccuuuacccagcacagaucaaggccagacagaugauaagccccgucaugagugugauuggguuuuuggcucuggccaaagauugguccgacaggaucgagcaguggcuaucugaaccuuguaagcuccugccagauacugcagcuguaagccuucacggagguccggccaccaaccgggacuaucugcgucaacgccagguugcguugggcaauauggagacaaaagaguccaaggccauuagacagcaugcagaagcugccgggugcucaaugaucgaggauaucgaaagucccagcucuauuuggguguucgcuggagccccugacagguguccacccacuugccucuuuauagcaggcaucgccgagcugggugcuuucuuuuccauuuuacaagauaugcggaacaccaucauggcgucaaaaacagucgggaccagcgaagagaagcugcgaaagaaaaguucuuucuaccaguccuaccuccgcagaacgcagagcaugggaauacagcuugaccaaaggauuaucgugcuguuuaugguggcauggggcaaggaggccgucgauaauuuccacuugggcgacgauauggacccugaacuacggacucuggcucagucgcucaucgacguuaaagugaaggagauuucuaaccaggaaccacugaaacuuuga

SEQ ID NO: 5719 - RNA, 1290 nt, Artificial Sequence
  derived and/or modified CDS sequence (opt3) from HTNV(CGRn93MP8)__EF990905.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccccuauacaggcaaagaucgacgaauugaaacgucaauuagccgauagaauugcuacuggaaagaaccuggguaaggagcaggacccaacgggcguggaaccgggggaucaucuaaaagagaggagcaugcucuccuauggaaauguacuggaccuuaaccaccuggauaucgacgagcccaccggccagacagcagauugguugucuauugugaucuaccucacuucauucgucgugccuauacugcugaaggcccucuauauguuaaccacacggggucgccagaccacuaaagacaauaaggggaguagaaucagguuuaaagaugacagcuccuucgaagacguuaacggcauucggaagccaaagcaucuguacgugucucuucccaaugcucaaucgucaaugaaagccgaggaaaucacaccuggacgcuaucgaaccgcgauuugcggcuuguacccagcacagaucaaggccagacagaugauaagccccgucaugagugugauuggguuucuggcucuagccaaagauugguccgacaggaucgagcaguggcucucugaaccuuguaagcugcuuccagauacggcagcuguaagccugcacggagguccggccacuaaccgggacuauuugcgucaacgccagguugcgcucggcaauauggagaccaaagaguccaaggccauuagacagcaugcagaagcugccgggugcucaaugaucgaggauaucgaaagucccagcucuauuuggguguucgcuggagccccugacagguguccacccacaugccuguuuauagcaggcaucgccgaguuaggugcuuucuuuuccauucugcaagauaugcggaacacuaucauggcgucaaaaaccgucgggacaagcgaagagaagcuccgaaagaaaaguucuuucuaccaguccuaccuucgcagaacccagagcaugggaauacagcuggaccaaaggauuaucguguuguuuaugguggcauggggcaaggaggccgucgauaauuuccaccuaggcgacgauauggacccugaacugcggacgcucgcucagucgcugaucgacguuaaagugaaggagauuucuaaccaggaaccacuuaaacuguga

SEQ ID NO: 5720 - RNA, 1290 nt, Artificial Sequence
  derived and/or modified CDS sequence (opt3) from HTNV(CGRn93P8)__EF990904.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguacgugucucuuccaaaugcucaaucgucaaugaaagccgaggaaaucacccccggacgcuaucgaacggcgauuugcggcuuguacccugcacagaucaaggccagacagaugauaagcccagucaugagugugauuggguuucuggcucuagccaaagauugguccgacaggaucgagcaguggcucucugaacccuguaagcugcuuccugauacugcagcuguaagccugcacggagguccagccaccaaccgggacuauuugcgucaacgccagguugcgcucggcaauauggagacaaaagaguccaaggccauuagacagcaugcagaagcugccgggugcucaaugaucgaggauaucgaaaguccgagcucuauuuggguguucgcuggagcccccgacagguguccuccaacuugccuguuuauagcaggcaucgccgaguuaggugcuuucauuuccauccugcaagauaugcggaacaccauaauggcgucaaaaacagucgggaccagcgaagagaagcuccgaaauaagaguucuuuuuaccaguccuaccuucgcagaacgcagagcaugggcauucagcuggaccaaaggaucaucguguuguucaugguggcauggggaaaagaggccgucgauaacuuucaccuaggcgacgauauggaccccgaacugcggacucucgcucagucgcugauugacguuaaggugaaagagaucucuaaucaggaaccucuuaagcuguga

SEQ ID NO: 5721 - RNA, 1290 nt, Artificial Sequence
  derived and/or modified CDS sequence (opt3) from HTNV(CGRni1)__EU363812.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguagggagcaggacccuaccggcguggaaccaggggaucaucuaaaggagcgguccaugcucucuuauggaaauguacuggaccuuaaccaccuggauaucgacgagccgacaggccagacugcugauugguugucaauugugaucuaccucaccaguuucgucgugcccauacugcugaaagcacucuauauguuaacaacccgcgguagacagacuacaaaggacaauaaagggaccaggauccgguuuaaggaugacagcuccuucgaagacauuaacggaauccgcaaaccuaagcaucuguacguuucucuuccaaaugcccaaucgucaaugaaggcugaggaaauuacgcccggccgauauagaacugccaucugcggcuuguacccugcgcagauaaaagcaaggcagaugauuagcccagugaugagugucaucggguuucuggcccuagcuaaggauugguccgaccggauugagcaguggcucucugaacccuguaaacugcuuccugauaccgccgcagugagccugcacggagguccagcuacaaaccgugacuauuugcgccaaagacagguagcccucggcaauauggagacuaaggaguccaaagcgaucaggcagcaugccgaaucagcagggugcaguaugguugaggauaucgaaagcccgucuuccauuuggguguucgcuggagcccccgaccgguguccuccaaccugccuguuuauagcuggcaucgccgaguuaggugcauucuuuucaauucugcaagauaugcgaaacacaaucauggccagcaagaccgucgggacgagugaagagaaacuccgcaagaagucuuccuucuaccagagcuaccuuagaaggacucagucgaugggaauacagcuggaccaacggauuaucguguugcuaaugguggcuuggggcaaagaggcggucgauaauuuucaccugggcgacgauauggaccccgaacuccgcacacuggcacagucucuuaucgacguuaaggugaaagagauuuccaaccaggaaccucugaaguuguga

SEQ ID NO: 5722 - RNA, 1290 nt, Artificial Sequence
  derived and/or modified CDS sequence (opt3) from HTNV(CJAp93)__EF208929.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaaccuggguaaggagcaggacccuaccggcguagaaccaggggaucaucuaaaagagagguccaugcucucuuauggaaaugugcuggaccuuaaccaccuggauaucgacgagccgacaggccagacugccgauugguugucaauugucguguaccucaccaguuucguugugcccauccugcugaaggcucucuauauguuaacaacccggggucgccagacuacaaaagacaauaaggggaccagaauaagguuuaaagaugacagcuccuucgaagacgucaacggaauccggaagccuaagcaucuguacgugucucuuccaaaugcacaaucgucaaugaaagccgaggaaauuacgcccggccgcuaucgaacugcuaucugcggcuuguacccugcccagauuaaggcgagacagaugaucagcccaguaaugaguguuauaggguuucuggcacuagccaaagauugguccgacaggauugagcaguggcucucugaacccuguaagcugcuuccugauaccgcugccgugggacuguuggguggcccagcaacaaaccgggacuaucuccgucaacgccaggucgcucuggggaauauggagacuaaagagagcaaggccaucagacagcacgcggaagccgcaggaugcuccaugauugaggauaucgaaucaccgaguagcaucuggguguucgcuggcgcccccgacagguguccuccaaccugcuuauuuauugcugguauagccgagcugggggcauucuuuucuauccuccaagauaugcggaacacaauuauggccuccaaaaccgugggaacgucagaagagaagcugcgaaagaaaagcaguuucuaccagucuuaccuucgcagaacucaguccaugggcauccaguuggaccaaaggauaauuguccuauuuaugguugcuuggggcaaggaggcggugaauaacuuccaucugggggaugacauggaucccgaacuccggacacuggcacagagccuuaucgacguaaaagugaaggagaucucgaaucaggaaccucugaaauuguga

SEQ ID NO: 5723 - RNA, 1290 nt, Artificial Sequence
  derived and/or modified CDS sequence (opt3) from HTNV(Aa14_207)__KX687234.1__N
auggccaccauggaggaacugcagagagagaucaacgcucacgaaggccaacucgugauugcaaggcagaagguccgggacgccgagaaacaguacgggaaggaucccgacgaacuuaauaaacgcgcgcugacagaucgagagggaguugcugugagcauacaggccaagaucgacgaguugaaacgucaauuagcagauagaauugccacugguaagaaccugggcaaggaacaggacccuacggggguagagccaggagaucaucuaaaagaaagguccaugcucucuuauggcaaugugcuggaccuuaaccaccuggauaucgacgagccgaccggucagacagcugauugguugucaauugucguguaccucaccaguuucguugugcccauccugcugaaggcacucuauauguuaacuacacgggggcgccagaccacuaaagacaauaagggaacaagaauaagguuuaaagaugacagcuccuucgaggacgucaacggcauccggaagccuaagcaucuguacgugucucuuccaaaugcccaaucgucaaugaaagcugaagagauuacccccggccgcuaucgaacggccguaugcggguuguacccugcgcagaucaaggcaagacagaugauuagcccaguuaugagugugaucggauuucuggcccuagcuaaagauugguccgacaggauagaacaguggcucucugagcccuguaagcugcuuccugauacugccgcagucagccuguuggguggcccagcuaccaaccgggacuaucuccgucaacgccagguggcccuggggaauauggaaacaaaagaguccaaggcgauuagacagcacgccgaggcagcuggaugcucaaugaucgaagauauugagaguccgagcucuaucuggguguucgccggcgcucccgacagguguccuccaacuugcuuauuugucgccgguaucgcagaacugggggccuucuuuuccauucuccaagauaugcggaacaccauaauggcuucaaaaacaguuggaaccagcgaggaaaaacuucgaaagaagaguucuuucuaccaguccuaccugcgcagaacgcagagcaugggcauccaguuggaccaaaggauuaucgugcuauuuaugguagcguggggcaaggaggcaguggauaauuuccaucugggggacgauauggaccccgagcuccggacucuggcccagucgcuuauagacgucaaagugaaggaaauuucuaaccaggagccucugaaauuguga

SEQ ID NO: 5724 - RNA, 1290 nt, Artificial Sequence
  derived and/or modified CDS sequence (opt3) from HTNV(Aa14_234)__KX687235.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugugagcauacaggccaagaucgacgaauugaaacgucaauuagcagauagaauugccacuggaaagaaccuggguaaggagcaggacccuacgggcguagaaccaggggaucaucuaaaagagagguccaugcucucuuauggaaaugugcuggaccuuaaccaccuggauaucgacgagccgaccggccagacagcugauugguugucaauugucguguaccucaccaguuucguugugcccauccugcugaaggcacucuauauguuaacuacacggggucgccagaccacuaaagacaauaaggggacaagaauaagguuuaaagaugacagcuccuucgaagacgucaacggaauccggaagccuaagcaucuguacgugucucuuccaaaugcccaaucgucaaugaaagcugaggaaauuacccccggccgcuaucgaacggccguaugcggcuuguacccugcgcagaucaaggcaagacagaugauuagcccaguuaugagugugaucggguuucuggcccuagcuaaagauugguccgacaggauagagcaguggcucggagaacccuguaagcugcuuccugauacugccgcagucucucuguuggguggcccagcuaccaaccgggacuaucuccgucaacgccagguggcccuggggaauauggagacaaaagagagcaaggcgauuagacagcacgccgaagcagcuggaugcuccaugaucgaggauauugaaucaccgaguagcaucuggguguucgccggcgcucccgacagguguccuccaacuugcuuauuuaucgccgguauugcagagcugggggccuucuuuucuauacuccaagauaugcggaacaccaucauggcuuccaaaacagucggaaccucagaagagaagcugcgaaagaaaagcaguuucuaccagucuuaccuucgcagaacgcaguccaugggcauucaguuggaccaaaggaucauaguucuauuuaugguggcguggggcaaggaggcaguagauaauuuccaucugggggacgauauggaccccgaacuccggacucuggcccagagccuuauugacgugaaagucaaggagaucucgaaccaggaaccucugaaauuguga

SEQ ID NO: 5725 - RNA, 1290 nt, Artificial Sequence
  derived and/or modified CDS sequence (opt3) from HTNV(Aa14_239)__KX687236.1__N
auggccaccauggaggaacugcagagagagaucaacgcucacgaaggccaacucgugauugcaaggcagaagguccgggacgccgagaaacaggaugggaaggaccccgaugaacuuaauaaacgcgcgcugacagaccgagagggaguugcugugagcauacaggccaagaucgaugaguugaaacgucaauuagcagacagaauugccacugguaagaaccugggcaaggaacaggauccuacggggguagagccaggagaccaucuaaaagaaagguccaugcucucuuacggcaaugugcuggaucuuaaccaccuggacaucgaugagccgaccggucagacagcugacugguugucaauugucguguaucucaccaguuucguugugcccauccugcugaaggcacucuacauguuaacuacacgggggcgccagaccacuaaagauaauaagggaacaagaauaagguuuaaagacgacagcuccuucgaggaugucaacggcauccggaagccuaagcaucuguaugugucucuuccaaaugcccaaucgucaaugaaagcugaagagauuacccccggccgcuaccgaacggccguaugcggguuguauccugcgcagaucaaggcaagacagaugauuagcccaguuaugagugugaucggauuucuggcccuagcuaaagacugguccgauaggauagaacaguggcucggugagcccuguaagcugcuuccugacacugccgcagucucucuguugggcgggccagcuaccaaccgggauuaccuccgucaacgccagguggcccugggaaauauggaaacaaaagagagcaaggcgauuagacagcacgccgaggcagcuggcugcuccaugaucgaagacauugagucaccgaguagcaucuggguguucgccggugcucccgauagguguccuccaacuugcuuauuuaucgccgggauugcagaacugggagccuucuuuucuauacuccaagacaugcggaacaccaucauggcuuccaaaacagucggcaccucagaggaaaagcugcgaaagaaaagcaguuucuaucagucuuaccuucgcagaacgcaguccaugggcauucaguuggaucaaaggaucauaguucuauuuaugguggcgugggggaaggaggcaguagacaauuuccaucugggagaugacauggaccccgagcuccggacucuggcccagagccuuauugaugugaaagucaaggaaaucucgaaccaggagccucugaaauuguga

SEQ ID NO: 5726 - RNA, 1290 nt, Artificial Sequence
  derived and/or modified CDS sequence (opt3) from HTNV(AY133/2011)__KY807166.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaacaucgguaaggagcaggacccuacgggcguggaaccaggggaucaucugaaagagagguccaugcuaucuuauggaaauguacucgaccugaaccaccuugauauugacgagccgaccggccagacagcagauuggcugucaaucgugauauacuugaccaguuucgucgugcccauccuccugaaggcccuguauaugcucacuacacggggucgccagaccacuaaagacaauaaggggacaagaauuagguuuaaagaugacagcuccuucgaagacguuucuggaauccggaagccuaagcauuuauaccugucgcuuccaaacgcucaaucaagcaugaaagccgaggaaauuacccccggccgcuaucgaacggcgaucugcggcuuguacccugcacagauaaaggccagacagaugauuaguccagugauguccgucaucggguuucuggcucuagccaaagauuggucugacaggauugagcaguggcucagcgaacccuguaagcugcuuccugauacugcagcugugucccugcacggagguccagccaccaaucgggacuauuugcgucaacgccagguagcgcucggcaacauggagacaaaagagucaaaggccaucagacagcaugcagaaacugcugggugcaguaugaucgaugacauugagagcccgucuuccauauggguuuucgccggagcucccgauagguguccuccaaccugccuguuuaucgccggcauugcagaauuaggugccuucuuuucaauccugcaagacaugcggaauacaauaauggcuagcaaaaccguggggacgagugaggaaaagcuccgaaagaaaucuuccuucuaccagagcuaccuucgcagaacucagucgaugggcauucagcuggaucaaaggaucaucgucuuguuuaugguggcguggggaaaggaggcaguggacaacuuccaccuaggcgaugacauggaccccgagcugcggacacucgcccagucucugauugaugucaaaguuaaggaaaucuccaaucaggagccucuuaaacuguga

SEQ ID NO: 5727 - RNA, 1290 nt, Artificial Sequence
  derived and/or modified CDS sequence (opt3) from HTNV(GAN13/2011)__KY807168.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguaccuuucuuugccaaaugcucaaucgucaaugaaagccgaggaaaucacccccggacgcuaucgaacggcgauuugcggccuguacccugcacagaucaaggccagacagaugauaagcccagugaugagugucauuggguuucuagcucucgccaaagauugguccgacaggaucgagcaguggcugucugaacccuguaaacuucugccugauacugcagcugugagcuugcacggagguccagccaccaaccgggacuaucuccgucaacgccagguagcgcugggcaauauggagacaaaggaguccaaggccauuagacagcaugcagaaacugcugggugcucaaugaucgaugacaucgagaguccgagcucuauuuggguuuucgccggagcucccgauagguguccuccaaccugcuuauuuauagccggcaucgcagaacugggugccuucuuuuccauucuccaagacaugcggaacacaaucauggcuucaaaaaccguggggacgagcgaggaaaaacuucgaaagaagaguucuuucuaccaguccuaccugcgcagaacucagagcaugggaauacaguuggaucaaaggauuaucguccuauuuaugguggcguggggcaaggaggcaguggacaauuuccaccugggcgaugacauggaccccgagcuccggacacuggcccagucgcuuaucgaugucaaaguuaaggaaauuucuaaccaggagccucugaaauuguga

SEQ ID NO: 5728 - RNA, 1290 nt, Artificial Sequence
  derived and/or modified CDS sequence (opt3) from HTNV(GAN19/2011)__KY807172.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacagaucgagaggggguugcugccagcauacaggcaaagaucgacgaauugaaacgucaauuagccgauagaauugcuacuggaaagaaccuggguaaggagcaggacccuacgggcguggaaccaggggaucaucuaaaagagagguccaugcucucuuauggaaauguacuggaccuuaaccaccuggauaucgacgagccgaccggccagacagcagauugguugucaauugugaucuaccucaccaguuucgucgugcccauacugcugaaggcccucuauauguuaacuacacggggucgccagaccacuaaagacaauaaggggacaagaaucagguuuaaagaugacagcuccuucgaagacguuaacggcauucggaagccuaagcaucuguaccuuucuuugccaaaugcucaaucgucaaugaaagccgaggaaaucacccccggacgcuaucgaacggcgauuugcggccuguacccugcacagaucaaggccagacagaugacuagcccagugaugagugucauaggguuucuagcucucgccaaagauugguccgacaggauugagcaguggcugucugaacccuguaaacuucugccugauaccgcagcugugagcuugcacggagguccagccacaucccgggacuaucuccgucaacgccagguagcgcugggcaacauggagacuaaggagucaaaggccaucagacagcaugcagaaaccgcugggugcaguaugauugaugacaucgagagcccgucuuccaucuggguuuucgccggagcucccgauagguguccuccaacaugcuuauuuauugccggcauagcagaacugggugccuucuuuucaauccuccaagacaugcggaauaccauuauggcuagcaaaacgguggggacaagugaggaaaaacuucgaaagaagucuucccuguaccagagcuacuugcgcagaacucagucgaugggaauccagcuagaucaaaggauaauuguccuguucaugguggcguggggcaaggaggcaguggacaacuuucaccucggcgaugacauggaccccgagcugcggacccuugcccagucucugaucgaugucaaaguuaaggaaaucuccaaucaggagccuuugaaacucuga

SEQ ID NO: 5729 - RNA, 1290 nt, Artificial Sequence
  derived and/or modified CDS sequence (opt3) from HTNV(LR1)__AF288294.1__N
auggccaccauggaggaacugcagagagagaucaacgcucacgaaggccaacucgugauugcaaggcagaagguccgggacgccgagaaacaguacgaaaaggaucccgacgagcuuaauaaacgcgcgcugacaaaccgagaggggguugcugugagcauacaggccaagaucgaugaauugaaaaugcaauuagcagaccguauugccacuggaaagaaucuggguaaggagcaggauccuacgggcguagaaccaggggaccaucuaaaagagagauccaugcucucuuauggaaacgugcuggaucuuaaucaccuggacaucgaugagccgaccggccagacagcugacugguugucaauuaucgucuaccucaccaguuucgugguucccauacugcugaaggcacucuauauguuaacuacaaggggucggcagaccacuaaagauaacaaggggacacgcaucagauuuaaagacgauagcuccuucgaagacgugaauggaauuaggaagccuaagcaucuguacgucucucuuccagacgcccaaucgucaaugaaagcugaggaaaucacccccggccgguaucgcacggccgugugcggcuuguacccugcgcagauuaaggcacgacagaugaucagcccaguaaugaguguuauaggguuucuggcccuagcuaaagauugguccgacagaauugagcaguggcucaucgaacccuguaagcugcuuccugauacugccgcagugucucuguugggagguccagcuaccaacagggacuaucuccggcaacgucaggucgcccugggcaauauggagacaaaagagagcaaggcgauucgccagcacgccgaagcagcugggugcuccaugaucgaggauaucgaaucaccgaguagcauuuggguguucgccggagcucccgacagauguccuccaacuugcuuauuuauagccggcaucgcagagcugggugccuucuuuucuauucuccaagauaugaggaacaccaucauggcuuccaaaacaguggggaccucagaagagaagcugcggaagaaaagcaguuucuaccagucuuaccuucgacgcacgcaguccaugggaauacaguuggaccaaagaauuaucguccuauuuaugguugcguggggcaaggaggcaguggauaauuuccaucugggcgacgauauggaccccgaacucaggacucuggcccagagccuuaucgacguaaaagugaaggagauuucgaaccaggaaccucugaaauuguga

SEQ ID NO: 5730 - RNA, 1290 nt, Artificial Sequence
  derived and/or modified CDS sequence (opt3) from HTNV(RG9)__AF288296.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucucugaacccuguaagcugcuuccugauaccgccgcaguaagccugcacggagguccagcuacaaaccgggacuauuugcgucaacgccagguugcccucggcaauauggagacuaaagaguccaaggcgauuagacagcaugccgaaucagcagggugcaguaugaucgaggauaucgaaagcccgucuuccauuuggguguucgcuggagcccccgacagguguccuccaaccugccuguuuauagcuggcaucgccgaguuaggugcauucuuuucaauucugcaagauaugcggaacacaaucaccgccagcaaaacggucgggacaagugaagagaagcuccgaaagaaaucuuccuucuaccagagcuaccuucgcagaacucagucgaugggaauacagcuggaccaaaggauuaucguguuguuuaugguggcuuggggcaaggaggcggucgauaauuuccaccuaggcgacgauauggaccccgaacugcggacccucgcacagucucugaucgacguuaaagugaaggagauuuccaaccaggaaccucuuaaacuguga

SEQ ID NO: 5731 - RNA, 1290 nt, Artificial Sequence
  derived and/or modified CDS sequence (opt3) from HTNV(S85-46)__AF288659.1__N
auggccaccauggaggaacugcagagagagaucaacgcucacgaaggccaacucgugauugcaaggcagaagguccgggacgccgagaaacaguacgaaaaggaucccgacgagcuuaauaaaagcgcgcugacaaaccgcgaggggguugcuguguccauacaggccaagaucgaugaauugaaaaugcaauuagcagaccgaauugccacuggaaagaaucuggguaaggagcaggauccuacgggcguagaaccaggggaccaucuaaaagagcguucuaugcucucauauggaaacgugcuggaucuuaaucaccuggacaucgaugagccgaccggccagacagcugacugguugaguauuaucgucuaccucacuagcuucgugguucccauacugcugaaggcacucuauauguuaaccacaagagguaggcagaccacuaaagauaacaaggggacacggauccgcuuuaaagacgauuccucuuucgaagacgugaauggaauuagaaagccuaagcaucuguacgucucgcuuccaaacgcccaaucaagcaugaaagcugaggaaaucacccccggcagguaucggacggccgugugcggcuuguacccugcgcagauuaaggcacgccagaugaucaguccaguaauguccguuauaggguuucuggcccuagcuaaagacuggucugaucgaauugagcaguggcucaucgaacccuguaagcugcuuccugacacugccgcagugagccuguugggagguccagcuaccaauagagauuaucucaggcaacggcaggucgcccugggcaacauggagacaaaagaguccaaggcgauucgucagcacgccgaagcagcugggugcucaaugaucgaggacaucgaaaguccgagcucuauuuggguguucgccggagcucccggccgcuguccuccaacuugcuuauuuauagccgguaucgcagagcugggggccuucuuuuccauucuccaagauaugagaaauaccaucauggcuucaaaaacagugggaaccagcgaagagaaacuuaggaagaagaguucuuucuaccaguccuaccugcggcgaacgcagagcaugggcauacaguuggaccaacgcauuaucguccuauuuaugguugcguggggcaaggaggcaguggauaacuuccaucugggggacgauauggaccccgaacucagaacucuggcccagucgcuuaucgauguaaaagugaaggagauuucuaaucaggaaccucugaaauuguga

SEQ ID NO: 5732 - RNA, 1290 nt, Artificial Sequence
  derived and/or modified CDS sequence (opt3) from HTNV(SN7)__AF288657.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaaacggaggaaaucacucccggacgcuaucgaaccgcuauuugcggcuuguacccugcccagaucaaggcgagacagaugauaagcccagucaugagugugauuggguuucuggcacuagccaaagauugguccgacaggaucgagcaguggcucucugaacccuguaagcugcuuccugauacagcugccguaagccugcacggagguccagcaacuaaccgggacuauuugcgucaacgccagguugcucucggcaauauggagaccaaagaguccaaggccauuagacagcaugcggaaucagccgggugcaguaugaucgaggauaucgaaagcccgucuuccauuuggguguucgcaggagcucccgacagguguccuccaacaugccuguuuauagccggcaucgcugaguuaggugccuucuuuucaauucugcaagauaugcggaacaccaucauggcaagcaaaacggucgggacaagugaagagaagcuccgaaagaaaucuuccuucuaccagagcuaccuucgcagaacucagucgaugggaauacagcuggaccaaaggauuaucguguuguuuaugguggccuggggcaaggaggcugucgauaauuuccaccuaggcgacgauauggaccccgaacugcggacccucgcgcagucucugaucgacguuaaagugaaggagauuuccaaccaggaaccucuuaaacuguga

SEQ ID NO: 5733 - RNA, 1290 nt, Artificial Sequence
  derived and/or modified CDS sequence (opt3) from HTNV(84FLi)__AF366568.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggcuagcauacaggccaagaucgacgaauugaaacgucaauuagcagauagaauugccacgggaaagaaccuggguaaggagcaggacccuaccggcguggaaccaggggaucaucuaaaagagagguccaugcucucuuauggaaauguacuggaccuuaaccaccuggauaucgacgagccgacaggccagacugcugauugguugucaauugugaucuaccucaccaguuucgucgugcccauacugcugaaggcacucuauauguuaacaacccggggucgccagacuacaaaagacaauaaggggaccagaaucagguuuaaagaugacagcuccuucgaagacguuaacggcauucggaagccuaagcaucuguacgugucucuuccaaaugcccaaucgucaaugaaagcugaggaaaucacgcccggacgcuaucgaacugccauuugcggcuuguacccugcgcagaucaaggcaagacagaugauaagcccagucaugagugugauuggguuucuggcccuagcuaaagauugguccgacaggaucgagcaguggcucucugaacccuguaagcugcuuccugauaccgccgcaguaagccugcacggagguccagcuacaaaccgggacuauuugcgucaacgccagguugcccucggcaauauggagacuaaagaguccaaggcgauuagacagcaugccgaaucagcagggugcaguaugaucgaggauaucgaaagcccgucuuccauuuggguguucgcuggagcccccaacagguguccuccaaccugccuguuuauagcuggcaucgccgaguuaggugcauucuuuucaauucugcaagacaugcggaauacaaucauggccagcaaaaccgucgggacgagugaagagaagcuccgaaagaaaucuuccuucuaccagagcuaccuucgcagaacucagucgaugggaauacagcuggaucaaaggauuaucguguuguuuaugguggcuuggggcaaggaggcggucgacaacuuccaccuaggcgaugacauggaucccgaacugcggacacucgcacagucucugaucgacguuaaagugaaggagauuuccaaucaggaaccucuuaaacuguga

SEQ ID NO: 5734 - RNA, 1290 nt, Artificial Sequence
  derived and/or modified CDS sequence (opt3) from HTNV(KHF,clone:4)__LC209206.1__N
auggccaccauggaggaacugcagagagagaucaacgcucacgaaggccaacucgugauugcaaggcagaagguccgggacgccgagaaacaguacgaaaaggaucccgacgagcuuaauaaacgcacacugacugaucgagaggggguugcggugagcauacaggcuaagaucgacgaauugaaacgucaauuagccgauagaauugcaacgggaaagaaccuggguaaggagcaggacccuaccggcguagaaccaggggaucaucuaaaagagagguccaugcucucuuauggaaaugugcuggaccuuaaccaccuggauaucgacgagccgacaggccagacugccgauugguugucaauugucguguaccucaccaguuucguugugcccauccugcugaaggcucucuauauguuaacaacccggggucgccagacuacaaaagacaauaaggggaccagaauaagguuuaaagaugacagcuccuucgaagacgucaacggaauccggaagccuaagcaucuguacgugucucuuccaaaugcacaaucgucaaugaaagccgaggaaauuacgcccggccgcuaucgaacugcuguaugcggcuuguacccugcccagaucaaggcgagacagaugauuagcccaguuaugagugugaucggguuucuggcacuagccaaagauugguccgacaggauagagcaguggcucucugaacccuguaagcugcuuccugauaccgcugccgucagccuguugggagguccagcaacaaaccgggacuaucuccgucaacgccagguggcucugggcaauauggagacuaaagaguccaaggccauuagacagcacgcggaagccgcagggugcucaaugaucgaggauauugaaaguccgagcucuaucuggguguucgcuggagcccccgacagguguccuccaaccugcuuauuuaucgcuggcauugccgagcugggugcauucuuuuccauacuccaagauaugcggaacacaaucauggccucaaaaaccgucgggacgagcgaagagaaacuucgaaagaagaguucuuucuaccaguccuaccugcgcagaacucagagcaugggcauucaguuggaccaaaggaucauaguucuauuuaugguggcuuggggaaaggaggcgguagauaauuuccaucugggcgacgauauggaccccgaacuccggacacuggcacagucgcuuauugacgugaaagucaaggagaucucuaaccaggaaccucugaaauuguga

SEQ ID NO: 5735 - RNA, 1287 nt, Artificial Sequence
  derived and/or modified CDS sequence (opt3) from LANV(510B)__AF005727.1__N
augagcaaccugcaggaggugcaagaaggcaucacccuccacgagcagcagcuugucgccgcuagacagaagcugaaggacgcagaaaaggccguugagguggaucccgacgauguaaauaaauccacauugcaaucuaggcgggcggcugugucagccuuagaaaacaagcuggcagagcuaaaacgccagcucgccgaccuggucgcugcacagaaacuugccgcuaagccuguggauccaacugggcuggagccggacgaucauuugaaggaaaagagugcccuccgauacggaaauguucuggacgugaacgcgauugaucuggaggaacccagcggucagacggcagacuggaaagccauaggcgcuuauauccucggguucgucauuccuaucauuuuaaaggcccuguacaugcuuuccacccguggaagacaaacagugaaagagaauaagggcacuaggauccgguuuaaggaugacucuucguucgaggaaguaaacgguauacgcaaaccaaagcacuuguauguuucaaugcccaccgcacagagcacaaugaaagcugaugagaucaccccugggagauuuaggacuauugccugcggacuguucccagcgcagaucaaggcccggaauauuaucagucccgugaugggcgucauaggcuuugggcauuucgugaaagacuggauggaacgcauugacaacuuucuaggagaggauuguccuuuccucccaaaggcacgagugcaguccgaggcuuuuaugucuacaaauagagccuacuuccugaacaggcaacggcaggucgacgaaagccguauccaggauauuguugaccuuauccaagcugccgaggcauccucagccacccuguuuaaugauaucgcuacgccgcacagugcguggguguucgcaugcgcccccgaccgcuguccuccaacugcuuuguauguagccggugugcccgaacucggcgcauuuuucgccauucugcaggauaugagaaacaccauaauggcuagcaaaucugucgggacagccgaggaaaaguuaaagaaaaaguccgcauucuaccagucauaucugaggcggacucagagcaugggaauccaacucgaccagaaaauuaucauacuuuacaugcugaguuggggcaaggaggcggugaaucauuuucacuugggugaugacauggauccugaacuacgacagcuggcucagacccucauugacgccaaaguuaaggagaucucuaaccaagagccacugaaacuuuga

SEQ ID NO: 5736 - RNA, 1287 nt, Artificial Sequence
  derived and/or modified CDS sequence (opt3) from LANV(12234)__ALD61435.1__N
augagcacccugcaggaggugcaagaaggcaucacacuccacgagcagcagcuugucgccgcuagacagaagcugaaagacgcagaaaaggccguugagguggaucccgacgauguaaacaaauccacuuugcaaucuaggcgggcggcugugucagccuuagaaaauaagcuggcagagcuaaaacgccagcucgccgaccuggucgcugcacagaaacuugccgcuaagccuguggauccaacggggcuggagccggacgaucauuugaaggaaaagagugcccuccgauacggaaacguucuggacgugaaugcgauugaucuggaggaacccagcggucagaccgcagacuggaaagccauaggcgcuuauauccucggguucgucauuccuaucauuuuaaaggcccuguacaugcuuuccacacguggaagacaaacugugaaagagaacaagggcaccaggauccgguuuaaggaugacucuucguucgaggaaguaaaugguauacgcaaaccaaagcaguuguauguuucaaugcccacagcacagagcaccaugaaagcugaugagaucacuccugggagauuuaggacaauugccugcggacuguucccagcgcagaucaaggcccggaacauuaucagucccgugaugggcgucauaggcuuuucccacuucgugaaagacuggauggaacgcauugacgauuuucuagcagcugacuguccuuuccucccaaagccgcgagugcaaucugaggccuuuauggcuaccaauagagccuacuucaucaacaggcagcggcagauugaugaaagccguaugcccgacaucauggaucugauccaagcagccgaggcuggguccgcgacgcuuuuuaaugacauugcaacuccucauucagccugggucuucgcuugcgccccagaucgcugucccccuaccgcacuguauguugccggagugccagaguugggugccuuuuucgcuauacuccaggacaugagaaacacaaucauggcaaguaaaagcguaggcacugcggaagagaagcugaagaaaaagucugcuuucuaccaguccuauuuaaggcggacccagucaauggggauucaacuggaucagaaaaucauaauucucuacaugcuuagcuggggaaaggaagccgugaaucacuuucaucugggcgacgauauggaccccgaguugcgacagcuagcacagacacugaucgacaccaaagucaaggaaaucaguaaccaagagccgcucaagcuguga

SEQ ID NO: 5737 - RNA, 1272 nt, Artificial Sequence
  derived and/or modified CDS sequence (opt3) from LQUV(Longquan-Rs-32)__JX465422.1__N
auggccaccggcagagaccugcaggaugagcucgaacaaaucgagcaggaaauuacacaggcuaaggcaaaauacgagaagcagaaagccgcgauaggggaggaacccgacacuaucgagcuuaaggugcugcaacagagggaagagacgauucacauguuggaagagaaacggaaggaguuacugcagcgcaucgcucagcaaaugaaaagcccucgacagccagucaaaggacgugaucuagacgaagaugagcaucucuccgaaagaucuacccugagguaugguaacguuauugaccuugaggaacuggauaucgacgagccggccggcgggucagcagauugguuggccauaggaaucuacauuuucaguuuucccgugcagcuccugcugaagacacucuauaucuuaacuacccggggccgccagacaauuaaagagaauaaggguaacagacugagguucaaagacagcuccucuaccauggauguaaauggggugaagacuccucggcaccuuuacaucucguugccaacagcucaaucaagcaugaagaccgaagagauaacgcccggacgcuaucgaacugucgcaugcggcauucugaguggcgaaaugagagccaggaaacucguguccccuguuaugggggugaucggauuuaacuaccucgcugagaaguggggugaauauauugacgccuuccugaugaaacagucuccacaucuucccgucagcaccggcuccccugagucagcgacaaauuuugcauaccugauccagcggcaagauguguugaacaagaguaaaacuguagaguaccucgaacugugggagcaggccgaaaaggcugggcgucacuuaguugaccgcaucgagagcccacugaccccguggcuauucgccggaucucccgacagauguccuccaacaucccuuuauguggcaggcauugcugaacugggugccuuuuucucaauauugcaggauaucaggaaugcgauuauggccagcaagcuagucgggaccgcagaggagaagcugaagcggaaaaguucuuuuuaccaguccuaucuccgacgcacgcaaagcaugggagugcagcuggaccagagaaucauaauucuuuacaugauggaauggggcaagaugaugguggaucauuuccaccugggcgacgauauggacucggaguugaggaaggcuugccagucucucaucgaugaaaaagucgcccaaguuuccaaccaggaggcucugaaauuauga

SEQ ID NO: 5738 - RNA, 1272 nt, Artificial Sequence
  derived and/or modified CDS sequence (opt3) from LQUV(Longquan-Ra-14)__JX465414.1__N
auggccaccggcagagaccugcaggaugagcucgaacaaaucgagcaggaaauuacacaggcuaaggcaaaauacgagaagcagaaagccgcgauaggggaggaacacgacacuaucgagcuuaaggugcugcaacagagggaagagacgauucauauguuggaagagaaacggaaggaguuacugcagcgcaucgcucagcaaaugaaaagcccccgacagccugucaaaggacgugaucuagacgaagaugagcaccucuccgaaagaucuacccugagguaugguaacguuauugaccuugaggaacuggauaucgacgagccagccggcgggucagcagauugguuggccauaggaaucuacauuuucaguuuuccggugcagcuccugcugaagacacucuauaucuuaacuacccggggccgccagacaauuaaagagaauaaggguaacagacugagguucaaagacagcuccucuaccauggauguaaauggggugaagacuccccggcaucuuuacaucucguugccuacagcucaaucaagcaugaagaccgaagagauaacgccaggacgcuaucgaacugucgcaugcggcauucugaguggcgaaaugagagccaggaaacucgugucccccguuaugggggugaucggauuuaacuaccucgcugagaaguggggugaauauauugacgccuuccugaugaaacagucuccucaccuuccagucagcaccggcucccccgagucagcgacaaauuuugcauaccugauccagcggcaagauguguugaacaagaguaaaacuguagaguaccucgaacugugggagcaggccgaaaaggcugggcgucauuuaguugaccgcaucgagagcccucugaccccauggcuauucgccggaucuccggacagaugucccccuacaucccuuuauguggcaggcauugcugaacugggugccuuuuucucaauauugcaggauaucaggaaugcgauuauggccagcaagcuagucgggaccgcagaggagaagcugaagcggaaaaguucuuuuuaccaguccuaucuccgacgcacgcaaagcaugggagugcagcuggaccagagaaucauaauucuuuacaugauggaauggggcaagaugaugguggaucacuuccaccugggcgacgauauggacucggaguugaggaaggcuugccagucucucaucgaugaaaaagucgcccaaguuuccaaccaggaggcucugaaauuauga

SEQ ID NO: 5739 - RNA, 1272 nt, Artificial Sequence
  derived and/or modified CDS sequence (opt3) from LQUV(Longquan-Ra-25)__JX465415.1__N
auggccaccggcagagaccugcaggaugagcucgaacaaaucgagcaggaaauuacacaggcuaaggcaaaauacgagaagcagaaagccgcgauaggggaggaacccgacacuaucgagcuuaaggugcugcaacagagggaagagacgauucacauguuggaagagaaacggaaggaguuacugcagcgcaucgcucagcaaaugaaaagcccuaagcagccagucaagggacgagaucuagacgaagaugagcaucucuccgaacguucuacccugagauaugguaacguuauugaccuugaggaacuggauaucgacgagccggccggcgggucagcagauugguuggccauaggaaucuacauuuucaguuuucccgugcagcuccugcugaaaacacucuauaucuuaacuaccaggggccggcagacaauuaaggagaauaaagguaaccgccugagauucaaggacagcuccucuaccauggauguaaauggggugaagacuccuaggcaccuuuacaucucguugccaacagcucaaucaagcaugaaaaccgaagagauaacgcccggacgguaucgcacugucgcaugcggcauucugaguggcgaaaugcgagccagaaagcuaguguccccuguuaugggggugaucggauuuaacuaccucgcugagaaauggggugaauauauugacgccuuccugaugaagcagucuccacaucuucccgucagcaccggcuccccugagucagcgacaaauuuugcauaccugauccagaggcaagauguguugaacaaaaguaagacuguagaguaccucgaacugugggagcaggccgaaaaagcugggcggcacuuaguugaccguaucgagagcccacugaccccguggcuuuucgccggaucucccgaccgcuguccuccaacaucccucuauguggcaggcauugcugaacugggugccuuuuucucaauauugcaggauaucagaaaugcgauuauggccagcaagcuagucgggaccgcagaggagaagcugaaaaggaagaguucuuuuuaccaguccuaucuccggcgaacgcaaagcaugggaauccagcuggaccagcgcauaauuauccuuuacaugauggaauggggcaaaaugaugguggaucauuuccaccugggcgacgauauggacucggaguugagaaaggcuugccagucucucaucgaugaaaaaguggcccaagucuccaaccaggaggcucugaaguuauga

SEQ ID NO: 5740 - RNA, 1287 nt, Artificial Sequence
  derived and/or modified CDS sequence (opt3) from NYV(RI-1)__U09488.1__N
augagcacccugaaggaggugcaggacaacaucacacuccacgaacaacagcuugucacugccagacagaaacugaaggaugcugagaaagcaguugaaguggaccccgaugacguaaauaaguccacguugcagggcaggcgggccgcggugucugcuuuagagaccaaacugggggaacuaaagcgccaacucgccgaucugauugcagcccagaaacuugcuucaaagccuauagacccaacaggaaucgagccggaugaccaucugaaggagaaaaguagcuugcgauacgguaacguccucgauguuaauuccauugaccuggaagaacccucuggccagacugcagauuggaaggccaucgggauguauauucugucguucgcuaucccuauaauccucaaagccuuauacaugcugucaacccguggaagacagacagugaaggaaaacaagggcaccaggauucgguuuaaagacgauagcaguuaugaggaggugaaugguauccgcaagccaagacaccuuuacgucuccaugcccacugcgcaaucuacaaugaaagcagacgaaauuaccccugggagguuccggacgaucgccugcggauuguuuccagcucaggugaaggcccgcaacauaauuagccccguaaugggcguuaucggcuucaacuuuuucgugaaagacuggauggaucgaauugacgauuuucuggcagagagauguccuuuccuaccagaaccgagggaccccaaggaugcugcccucgggacuaaucgggcguauuuuaucacccgucaggcccaggucgacgaguccaaagugguggauaucgaggagcugauugucgacgcacgcgcugagucagccacacuuuucgcugauauagccacuccucauaguguuuggguguuugcaugcgccccagacagaugucccccuaccgcucuguacguagcgggaaugccagaauugggugcauucuuugccauccuccaagauaugaggaauacaauuauggcuagcaagucugugggcaccgccgaggaaaagcugaaaaagaaauccgcauucuaucagucauacuuacggcgaacgcagagcauggggauccaacuggaccagaagauaauuauccucuacaugauccacuggggaaaagaggccgucaaccauuuccaccuuggcgacgauauggaccccgaacugcgcgaguuggcucaggcccuaguggaugcaaagguuaaggagauuaguaaucaggaaccgcugaaacucuga

SEQ ID NO: 5741 - RNA, 1302 nt, Artificial Sequence
  derived and/or modified CDS sequence (opt3) from PUUV(K27)__L08804.1__N
augagcgaccugaccgauauccaggaggaaauuacaagacacgagcaacagcucguggucgccaggcagaaacuuaaagacgcugaacgggcaguugagguguaccccgaugacguaauaaagaacacucugcaggcccgccaacagacgguguccgcguuggaagauaaauuagcugacuauaagcgacguauggccgaugcagucucuagaaagaagauggacaccaagccuacagauccaacuggcaucgagccggacgaucaucugaaagagaggucaagucuacgguacgggaaugugcucgacguuaacgccauugauaucgaagaacccagcggacagaccgcugacugguauacaauugguguguacgucaucggcuucaccauaccuaucauucugaaggcacuuuauaugcuguccacucgcgggagacagacagugaaagaaaauaagggaaccaggauccgguuuaaagacgauacgucuuucgaggacauuaacggcauccgccgaccaaagcacuuguacguaucgaugcccacugcccaaucaaccaugaaggcugaggaacucacaccugguagauuuaggacuauaguuugcgggcuguucccaacccagauucaggugcggaauaucaugagccccgucaugggagugauuggcuuuaguuucuuugugaaagauuggccugagaagauccgugaguucauggagaaagaauguccauuuaucaagccggaggucaaacccggcaccccugcccaggagguugaguuccugaagcgcaacagaguguauuuuaugacaaggcaagacguacucgauaaaaaucauguggcggacauugauaaguuaauagacuacgcagccuccggggauccaacgucucccgacgauaucaagagcccuaacgcuccaugggucuucgccugcgcacccgaccgguccccgccuacuuguauuuacguggcuggaauggccgaacugggugcguuuuucucaauccuucaggacaugcgaaauacaauaauggccaguaaaaccguuggcacugcagaagagaaguugaaacgcaagagcucuuucuaucaguccuaccugagaaggacacaaucaauggggauucagcuagaucagcggaucauccuccuguauaugcuugaauggggaaaagagaugguggaccacuuucaucugggcgaugacauggaucccgaguugcgcggucucgcucagagccugauugaccaaaaggucaaggaaaucaguaaccaggagccauuaaaaauuuga

SEQ ID NO: 5742 - RNA, 1302 nt, Artificial Sequence
  derived and/or modified CDS sequence (opt3) from PUUV(KS13/855)__KX815394.1__N
augagcgaccugaccgauauccaggaggacauuacaagacacgaacaacagcucguggucgccaggcagaaguuaaaagaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaacggauccgugaguuuauggaaaaagaguguccuuucauuaagccagaagugaaaccgggcacacccgcgcaggaggucgaguuucucaagaaaaauaagguuuauuucaugcaacgccaggacguguuagauaagaaccauguagcagacaucgauaaacugaucgacuacgccgcuaguggggauccuaccucuccagacaauauugaaagccccaacgccccuuggguguuugcaugcgcuccagacagaugucccccgacgugcauauaugucgccggaauggcggagcuuggugccuucuucuccaucuugcaggauaugaggaauacuauuauggcaucaaagacagugggcaccgcugaagagaaacugaagaaaaagaguagcuuuuaccaaucuuaccuacggcgaacucaguccauggggauccagcucgaccagcgcauaauucugcuuuauaugcuggaauggggaaaggagaugguugaucacuuccauuugggcgacgauauggacccugagcucagaggucuggcccaagcucuuaucgaucagaaagugaaggaaaucucaaaccaggagccccugaaaauuuga

SEQ ID NO: 5743 - RNA, 1302 nt, Artificial Sequence
  derived and/or modified CDS sequence (opt3) from PUUV(KS14/118)__KX815395.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuucaagcgacguauggccgaugcagucucuagaaagaagauggacaccaagccuacagauccaacuggcauagaaccggacgaucaucugaaagagaggucaagucuacgguacgggaacgugcucgacguuaaugccaucgacauugaggaacccagcggacagaccgcugauugguauacaaucgguguguacgucauuggcuuuaccaucccuauaauccugaaggcacuuuauaugcuguccacucgcgggagacagacagugaaagagaacaagggaaccaggauucgguucaaagacgauacgucuuuugaagacaucaauggcauucgccgaccaaagcacuuguacguaucgaugcccacugcccaaucaaccaugaaggcugaggagcucacaccugguagauucaggacuaucguuugcgggcuguuuccaacccagauacaggugcggaacauuaugagccccgucaugggagugaucggcuucuccuuuuucgugaaaaauuggccugaacguauuaaggaguuuauggaaaaagaguguccauucaucaagccggaagucaaacccggcaccccugcccaggagguugaguuucugaagcgcaacaaaguguauuucaugaauagacaagauguacucgacaagaaccauguggcggauaucgacaaguuaauugauuacgcagccaguggggacccaacaucucccgaugacauagaaagcccuaaugcuccaugggucuuugccugcgcacccgacagguguccgccuacgugcaucuauguggcuggaauggccgagcugggugcguucuucuccauucuucaggauaugcggaacacuaucauggccucaaaaacaguuggcaccgcagaagagaaguugaaaaagaaaaguagcuuuuaccagucuuaccugcgacgcacucaauccauggggauacagcuagaccagagaauuauccuccuguauaugcuugaauggggaaaggagaugguggaucacuuccaucugggcgacgauauggaccccgaguugaggggucucgcucaggcccugaucgaucaaaaggucaaagaaauuucaaaucaggagccauuaaagaucuga

SEQ ID NO: 5744 - RNA, 1302 nt, Artificial Sequence
  derived and/or modified CDS sequence (opt3) from PUUV(LT15/201)__KX757841.1__N
augagcgaccugaccgauauccaggaggacauuacaagacacgaacaacagcucguggucgccaggcagaaguuaaaagaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuauagauccaacaggcaucgaaccggacgaucaucugaaggagagaucaagucuaagguacgggaacguccucgacgugaaugccauugacaucgaggaacccagcggacagacugcugauugguauaccauugguguuuacgugaucggcuuuacacugccuauaauccuuaaagcacuguauauguuguccacccgggggcgccagacugucaaggagaacaaaggaacaagaauuagguucaaggacgauaccucuuuugaagacaucaauggcauucggcgcccaaagcaccucuacgugucgaugcccacggcccaaucaacuaugaaagcugaggagcugaccccuggucgauucagaacaaucguaugcgggcuguuuccaacucagauacagguuaggaacauuaugagccccgugaugggagucaucggcuucuccuuuuucgugaaggauugggccgaacggauucgugaguuuauggaaaaagaguguccuuucaucaagccagaagugaaaccgggcacccccgcgcaggaggucgaguuucucaagaaaaauaagguuuauuucaugcaacgccaggacguguuagauaagaaccauguagcagacaucgauaaacugauugacuacgccgcuaguggggauccuacaucuccagacaauauagaaagccccaacgccccuuggguguuugcaugcgcuccagacagaugucccccgaccugcaucuaugucgccggaauggcggagcuuggugccuucuucuccauuuugcaggauaugaggaauacgaucauggcaucaaagacugugggcacagcugaagagaaacugaagaaaaagaguagcuuuuaccaaucuuaccuacggcgaacccaguccauggggauacagcucgaccagcgcauuauccugcuuuauaugcuggaauggggaaaggagaugguugaucacuuccauuugggcgacgauauggacccugagcucagaggucuggcccaagcucuuaucgaucagaaagugaaggaaauuucaaaccaggagccccugaaaaucuga

SEQ ID NO: 5745 - RNA, 1302 nt, Artificial Sequence
  derived and/or modified CDS sequence (opt3) from PUUV(PUU/Ernstbrunn/Cg641/1995)__AJ888752.1__N
augagcgaccugaccgauauccaggaggacauuacaagacacgaacaacagcucguggucgccaggcagaaacuuaaagaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcaucaagcggccaaaacaccucuacgugucgaugcccacugcccaaucaaccaugaaggcugagaaacugacaccuggucgcuuccgaacuauuguaugcgggcuguuuccaacccagauccagguuagaaacauaaugagccccgugaugggagucauuggcuucagcuuuuucgugaaggauugguccgagagggugcgggacuuuauggaaaaagaguguccuuucaucaagccagaaauuaaaccgggcacacccccucaggaggccgaauuucucaagcguaauaaggucuauuucaugcaacgccaggauguuuuagacaaaaaccauguggcggauaucgacaagcugaucgauuacgcagccucuggggacccaaccagccccgacaaucuugaguccccuaacgcuccauggguauuugccugcgcacccgauagauguccgccuacgugcauuuauguggcuggaauggccgaguugggugcguucuucucaauacugcaggacaugaggaauacuaucauggccaguaaaacagucggcaccgcagaagagaagcuaaagaagaagaguucuuuuuaccaauccuaccuccggcgaacucagucaauggggauucagcuggaucagcgcaucauacuucuguauauguuggaauggggaaaagagaugguggaccacuuccaucucggcgaugacauggaucccgaacugagagguuuagcucaagcccugauugaccagaagguuaaagagaucagcaaccaggagccacucaagaucuga

SEQ ID NO: 5746 - RNA, 1302 nt, Artificial Sequence
  derived and/or modified CDS sequence (opt3) from PUUV(PUU/Klippitztoerl/Cg9/1995)__AJ888751.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccggaggucagaccgcugauugguauacaaucggcguuuacgugauuggguuuacccugccuaucauacuuaaagcacuguauauguucagcacucggggacgccagacagucaaggagaacaaaggcaccagaaucagguuuaaggacgauacguccuucgaagacauuaaugguauccggcgcccaaagcacuuguacgugucuaugcccacugcccaaucgaccaugaaagcugaggagcucacaccugggcgauuuagaacuauuguaugcggacuguucccaacccagauccagguuaggaacauaaugucacccgugaugggcgucauuggcuuuagcuucuuugugaaggauuggagugaacgggugcgugacuucauggagaaagaauguccuuuuaucaagccagagauuaaaccggggacacccccucaggaagccgaguuccugaagcgcaauaaagucuauuuuaugcaaagacaggauguucucgacaagaaccauguggcggauaucgacaaguuaaucgauuacgcagccuccggagacccaaccucucccgacaaucuggagagcccuaacgcuccauggguauucgccugcgcacccgauagguguccgccuacgugcauuuauguggcugguauggccgaacuuggcgcguucuuuuccauauugcaggacaugcggaauacuaucauggccucaaaaacagucgggaccgcagaggaaaagcugaaaaagaaaaguagcuucuaccaaucuuaccuacgacgcacucaguccaugggcauucagcucgaucagagaaucauacugcuuuauaugcuggaguggggaaaggaaaugguggaccacuuucauuugggugaugacauggaucccgagcucagggggcuggcucaagccuuaauugaccagaagguuaaagagaucucaaaccaggaaccacugaagaucuga

SEQ ID NO: 5747 - RNA, 1302 nt, Artificial Sequence
  derived and/or modified CDS sequence (opt3) from PUUV(Balkan-1)__AJ314600.1__N
augagcgaccugaccgauauccaggaggacauuacaagacacgaacaacagcucguggucgccaggcagaaacuuaaagaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauuggagugaacgggugcgugaguuuauggaaaaagaguguccuuucaucaagccagaaauuaaaccgggcacacccccucaggaggccgaguuucucaagcgcaauaaagucuauuucaugcaaagacaggacguuuuagauaagaaccauguggcggacaucgauaagcugcuugacuacgcagccucuggggauccaaccagccacgacaauaucgaaucccccaacgcuccuuggguauuugccugcgcaccagacaggugucccccgacgugcauuuauguggcuggaauggccgaguugggugcguucuucucaauacugcaggauaugcggaauacuaucauggccaguaaaacagucggcaccgcagaagagaagcuaaagaagaaaagcucuuuuuaccaauccuaccuccgacgcacucagucaauggggauucagcuggaccagagaaucauacuucuguauauguuggaauggggaaaggagaugguggaucauuuccaccucggcgacgauauggacccugagcugagggguuuagcucaagcccugauugaucagaagguuaaagaaaucagcaaccaggagccccucaagaucuga

SEQ ID NO: 5748 - RNA, 1302 nt, Artificial Sequence
  derived and/or modified CDS sequence (opt3) from PUUV(Balkan-2)__AJ314601.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguauuugggcuguucccaacccagauccagguuaggaacauaaugagccccgugaugggagucauuggcuuuaguuucuuugugaaggauugguccgaacgggugcgugaguucauggaaaaagagugcccuuuuaucaagccagaaauuaaaccgggcgcucccccucaggaggcggaguuccucaagcgcaauaaagucuauuuuaugcaaagacaggacguuuuagauaagaaccauguggcagacaucgauaagcugaucgacuacgccgcuucuggggauccaacaagccccgacaauauugaauccccuaacgccccauggguauucgcaugugcucccgacaggugcccgccuaccuguauauauguggccggaauggcggagcuuggugccuucuuuucaaucuugcaggauaugcggaauacgauuauggcaaguaaaacugucggcacagcugaagagaagcugaaaaagaaaagcucuuucuaccaauccuaccuacgacgcacccagucaauggggauccagcucgaccagagaauaauucugcuuuauaugcuggaauggggaaaggagaugguggaucacuuucauuugggcgacgauauggaccccgagcucaggggucuggcccaagccuuaaucgaucagaagguuaaagaaaucagcaaccaggagccacugaagauuuga

SEQ ID NO: 5749 - RNA, 1302 nt, Artificial Sequence
  derived and/or modified CDS sequence (opt3) from PUUV(Baltic/205Cg/00)__AJ314599.1__N
augagcgaccuggccgauauccaggaggacauuaccagacacgaacaacagcucguggucgcuaggcagaaacuuaaagaugcagagcgggccguugaaguggaccccgaugacguaaacaagaauacacugcaggcgcgccaacagacuguguccgcuuuggaggauaaauuagccgacuacaagcgacguauggcagaugccgucucuagaaagaagauggacacgaagccuaccgauccaacaggcauagaaccggacgaucaucugaaagagaggucaagucuacgguaugggaacgugcucgacguuaaugcuaucgacauugaggaacccagcggacagacugcagauugguacaccaucgguguguaugucauuggcuucacacugccuaucauacuuaaggcccuguacauguuguccacccgcgggagacagacugugaaagagaacaagggaacaaggauccgguuuaaagacgauaccucuuucgaagacauuaauggcauccgccgaccaaagcaccucuauguaucgaugcccacggcucaaucaacuaugaaggccgaggagcugaccccugguagauuuaggacaauuguuugcgggcuguucccaacucagauccaggugcggaacauaaugagccccgucaugggagugauuggcuuuaguuucuuugugaaagauuggccugaacguaucaaggaguucauggaaaaagaguguccauuuauuaagccggaagucaaacccggcaccccuacacaggagguugaguuccucaagcgcaauaaaguguacuuuaugaacagacaagacguauuagauaagaaucauguggcggacaucgauaagcugaucgacuaugcagccuccggggauccaaccucucccgacgacauugaaagcccuaacgcuccaugggucuucgccugcgcacccgauagguguccgccuacgugcauauacguggcuggaauggccgagcuuggugcguuuuucuccaucuugcaggacaugcggucaacuauuauggccaguaaaacaguuggcaccgcagaagagaagcugaaaaagaaaagcucuuucuaccaguccuaucuacgacgcacucaaucaauggggauccagcucgaucagagaauaauucugcuuuacaugcuggaauggggaaaggagaugguggaccacuuucauuugggcgaugacauggaucccgagcucaggggucuggcucaggccuuaaucgaccaaaaggucaaagaaaucagcaaucaggagccacugaagauuuga

SEQ ID NO: 5750 - RNA, 1302 nt, Artificial Sequence
  derived and/or modified CDS sequence (opt3) from PUUV(Baltic/49Cg/00)__AJ314598.1__N
augagcgaccuggccgauauccaggaggacauuaccagacacgaacaacagcucguggucgcuaggcagaaacuuaaagaugcagagcgggccguugaaguggaccccgaugacguaaacaagaauacacugcaggcgcgccaacagacuguguccgcuuuggaggauaaauuagccgacuacaagcgacguauggcagaugccgucucuagaaagaagauggacacgaagccuaccgauccaacaggcauagaaccggacgaucaucugaaagagaggucaagucuacgguaugggaacgugcucgacguuaaugcuaucgacauugaggaacccagcggacagacugcagauugguacaccaucgguguguaugucauuggcuucacacugccuaucauacuuaaggcccuguacauguuguccacccgcgggagacagacugugaaagagaacaagggaacaaggauccgguuuaaagacgauaccucuuucgaagacauuaauggcauccgccgaccaaagcaccucuauguaucgaugcccacggcucaaucaacuaugaaggccgaggagcugaccccugguagauuuaggacaauuguuugcgggcuguucccaacucagauccaggugcggaacauaaugagccccgucaugggagugauuggcuuuaguuucuuugugaaagauuggccugaacguaucaaggaguucauggaaaaagaguguccauuuauuaagccggaagucaaacccggcaccccugcgcaggagguugaguuccucaagcgcaauaaaguguacuuuaugaacagacaagacguauuagauaagaaucauguggcagacaucgauaagcugaucgacuaugccgcuuccggggauccaacaucucccgacgacauugaaagcccuaacgccccaugggucuucgcaugcgcucccgauagguguccgccuaccugcauauacguggccggaauggcggagcuuggugccuuuuucuccaucuugcaggacaugcggaauacgauuauggcaucaaaaacuguuggcacagcugaagagaagcugaaaaagaaaaguagcuucuaccagucuuaucuacgacgcacccaauccauggggauccagcucgaucagagaauaauucugcuuuacaugcuggaauggggaaaggagaugguggaccacuuucauuugggcgaugacauggaucccgagcucaggggucuggcccaggcuuuaaucgaccaaaaggucaaagaaaucucaaaccaggagccacugaagauuuga

SEQ ID NO: 5751 - RNA, 1302 nt, Artificial Sequence
  derived and/or modified CDS sequence (opt3) from PUUV(Pallasjarvi/63Cg/98)__AJ314597.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauugguccgaacguauccgcgaguucauggaaaaggaguguccuuuuauuaaaccagaagucaagccgggcacacccgcccaggagguugagaugcucaaaagaaauaagaucuacuucaugcaaaggcaggacguguuagauaaaaaccauguagcggacaucgauaagcugauugacuaugcagccucuggggauccuaccagcccagacaauauagacucccccaacgcuccuuggguguuugccugcgcaccagaucggugucccccgacgugcaucuacgucgcuggaauggccgaacuuggugcguucuuuucaauuuugcaggacaugcgaaauacuaucauggccaguaagacagugggcaccgcagaggaaaaacugaagaaaaagagcucuuucuaccaauccuaucuacgcagaacucagucaauggggauacagcucgaucagaggauuauccugcuuuucaugcuggaguggggaaaagaaaugguugaccacuuucauuugggcgaugacauggauccugagcuccggggucuggcucaagccuuaaucgaccagaaggugaaggagauuagcaaccaggaaccccugaaaaucuga

SEQ ID NO: 5752 - RNA, 1302 nt, Artificial Sequence
  derived and/or modified CDS sequence (opt3) from PUUV(Sotkamo 2009)__HE801633.1__N
augagcgaccugaccgauauccaggaggacauuacaagacacgaacaacagcucauaguggccaggcagaaacuuaaagaugcugagcgggcagucgaaguugaccccgaugacgugaacaagaauacucugcaggcccgccaacagacgguauccgcguuggaggauaaauuagcugacuacaagcgacguauggccgaugcagugucuagaaagaagauggacaccaagccuacagauccaacuggcaucgaaccggacgaucaucugaaagagaggucaagucuacgguaugggaacguccucgacgugaaugccauugacaucgaggaacccagcggacagaccgcugauugguacacaauugguguuuaugugaucggcuucacccugccuauaauccuuaaggcacuguacauguuguccacucgcgggagacagacagucaaagagaacaagggaaccaggauucgguuuaaagacgauacgucuuucgaagacaucaauggcauucgccgaccaaagcaccucuaugugucgaugcccacugcccaaucaaccaugaaggcugaggagcugacaccugguagauuuaggacuaucguaugcgggcuguucccaacccagauacagguucggaacauuaugagccccgugaugggagucaucggcuuuaguuucuuugugaaagauugguccgaacguauucgcgaguucauggaaaaggaguguccuuuuaucaaaccagaagugaagccgggcacacccgcccaggagaucgagaugcucaaaagaaauaagauuuacuucaugcaaaggcaggacgucuuagauaaaaaccauguugcggacauagauaagcugaucgacuaugcagccucuggggauccuaccagcccagacaauauugacucccccaacgcuccuuggguguuugccugcgcaccagaucggugucccccgacgugcaucuacguagcuggaauggccgaacuuggugcguucuuuucaauauugcaggacaugcgaaauacuauuauggccaguaagacagugggcaccgcagaggaaaaacugaagaaaaagagcucuuucuaccaauccuaucuacgcagaacucagucaauggggauccagcucgaucagaggaucauucugcuuuucaugcuggaguggggaaaagaaauggucgaccacuuucauuugggcgaugacauggauccugagcuccggggucuggcucaagccuuaaucgaccagaaggugaaggagauuagcaaccaggaaccccugaaaauauga

SEQ ID NO: 5753 - RNA, 1302 nt, Artificial Sequence
  derived and/or modified CDS sequence (opt3) from PUUV(CG 13891)__U22423.1__N
augagcgaccugaccgauauccaggaggacauuacaagacacgaacaacagcucguggucgccaggcagaaacuuaaagaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucaguuucuucgugaaggauugggccgacaggauccgggaauccauggagaaagaauguccuuuucucaagccagaugugaaaccgggcacacccgcgcaagagaccgaauuuuuaaagcguaauaaaauuuauuuuaugcagcgccaggagguccuggacaagaaccauguugcagagaucgauaaacuuaucgacuacgccgcuucuggggauccuacgagcccagacaauauugaaucccccaacgccccuuggguguucgcaugcgcuccagacagaugucccccgacuugcauauauguagccggaauggcggaguugggugccuuuuucucaauccugcaagauaugaggaauacaauuauggcaaguaagaccgugggcacugcugaagagaagcuaaagaagaaaagcucuuucuaccaguccuaccuccggcgaacacagucaauggggauccagcuggaccaacgcauaauucuucuguauauguuggaauggggaaaggagauggucgaucacuuucaucucggcgacgauauggacccugagcugagagguuuagcccaggcucugaucgaucagaaggugaaagaaaucagcaaccaggagccccucaagauuuga

SEQ ID NO: 5754 - RNA, 1302 nt, Artificial Sequence
  derived and/or modified CDS sequence (opt3) from PUUV(CG1820)__M32750.1__N
augagcgaccugaccgauauccaggaggaaauuacaagacacgagcaacagcucguggucgccaggcagaaacuuaaagacgcugaacgggcaguugagguggaucccgacgauguaaacaaguccacucugcaggcccgccaacagacggugucugcguuggaagacaaauuagcugauuacaagcgacguauggccgacgcagucucaagaaagaagauggauaccaagccuacagacccaacuggcauagagccggaugaccaucugaaagagaggaguagccuacgguaugggaaugugcucgauguuaacgccaucgacauugaagaacccuccggacagaccgcugacugguacacaaucgguguguaugucauuggcuucaccaucccuauaauccugaaggcacuuuacaugcugucuacucgcgggagacagacagugaaagaaaauaagggaaccaggauucgguuuaaagaugacacgucguucgaggauaucaacggcauucgccgaccaaagcacuuguauguaucaaugcccacugcccaaagcaccaugaaggcugaggaacucacaccugguagauuuaggacuaucguuugcgggcuguucccaacccagauacaggugcggaauauuaugagucccgucaugggagugaucggcuuuuccuucuuugugaaagacuggccugagaagauucgugaguucauggagaaagaauguccauuuaucaagccggaggucaaacccggcaccccugcccaggagguugaguuccugaagcgcaacagaguguacuuuaugacaaggcaagauguacucgacaaaaaucauguggcggauaucgacaaguuaauugauuaugcagccucuggggacccaacgagccccgaugacauagaauccccuaacgcuccaugggucuucgccugcgcacccgaccgguguccgccuacuugcaucuacguggcuggaauggccgaacugggugcguuuuucucaauucuucaggauaugcgaaauacaaucauggccaguaagaccguuggcacugcagaggaaaaauugaagaaaaagagcucuuucuaccaguccuaucugcgcagaacacaaucaauggggauacagcuagaccagaggauuauccuccuguacaugcuugaguggggacgggagaugguggaucacuuucaucugggcgacgauauggaccccgaauugcgcggucucgcucagagccugaucgaucaaaaagucaaggagauuaguaaccaggaaccauuaaagaucuga

SEQ ID NO: 5755 - RNA, 1302 nt, Artificial Sequence
  derived and/or modified CDS sequence (opt3) from PUUV(Bussjo_95-1)__AM746297.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauuggccugaccggauccgugaauuuauggagaaagaauguccauucauuaagccggaggugaaacccggcacaccuacccaggaaaucgaguuucucaagaaaaauaaggucuauuucauggaucgccaaaacguuuuagacaagaaucauguggccgauaucgacaaacugauugauuacgcggcaaguggggacccaacgucucccgacaacauagagagcccuaaugccccauggguauuugcuugcgcccccgauagauguccgccuacuugcaucuauguggcaggaauggcugaacuuggugccuucuucuccauuuugcaggacaugaggaacacaaucauggcgucaaagaccgucggcacugccgaggaaaaacugaagaaaaagaguagcuuuuaccagucuuaccuacggcgaacacaauccauggggauacagcucgaucagcgcauuauccugcuuuauaugcuggaguggggaaaggaaaugguggaccacuuccauuugggcgaugacauggaucccgagcucagaggucuggcacaggcuuuaaucgaccaaaaaguuaaggagauuucaaaucaggauccacugaaaaucuga

SEQ ID NO: 5756 - RNA, 1302 nt, Artificial Sequence
  derived and/or modified CDS sequence (opt3) from PUUV(CG144)__AF367064.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguauuuaugugaucggcuucacacugccuauaauccuuaaggcucuguacauguuguccacccgcgggagacagacuguuaaagagaacaagggaacaaggauucgguuuaaagacgauaccucuuucgaagacaucaauggcauucgccgaccaaagcaccucuaugugucgaugcccacggcccaaucaacuaugaaggcggaggagcugaccccugguagauuuaggacaaucgucugcgggcuguucccaacucagauacaggugcggaacauuaugagccccguaaugggaguuaucggcuuuaguuucuuugugaaagauuggccugaacguauucgcgaguucauggaaaaggaguguccauuuaucaaaccggaagucaagcccggcaccccugcacaggagaucgagaugcucaaaaagaauaaaauuuacuucaugcauagacaagacguguuagauaagaaccacguggccgacauagauaagcugaucgacuaugcugccuccggggauccaacaucucccgacaauauugacagcccuaacgcaccaugggucuuugcuugcgcccccgauagguguccgccuaccugcaucuacguugcgggaauggccgaacuuggugcauucuuuuccauauugcaggacaugcggaauacgauuauggcuucaaaaacugugggcacagccgaggaaaagcugaaaaagaaaaguagcuucuaccagucuuaucuacgacgcacccaauccauggggauccagcucgaucagagaaucauucugcuuuacaugcuggaguggggaaaggaaaugguagaccauuuccacuugggcgaugacauggaucccgagcucaggggucuggcucaggccuuaaucgaccaaaaggugaaagagauuucaaaccaggaaccacugaagauauga

SEQ ID NO: 5757 - RNA, 1302 nt, Artificial Sequence
  derived and/or modified CDS sequence (opt3) from PUUV(CG168)__AF367065.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguguguauguuauuggcuucacacugccuaucauacuuaaggcucuguacauguuguccacccgcgggagacagacugugaaagagaacaagggaacaaggauccgguuuaaagacgauaccucuuucgaagacauuaauggcauccgccgaccaaagcaccucuaugucucgaugcccacggcccaaucaacuaugaaggcggaggagcugaccccugguagauuuaggacaauugugugcgggcuguucccaacucagauccagguacggaacauaaugagccccguuaugggagugauuggcuuuaguuucuuugucaaagauuggccugaacguauccgcgaguucauggaaaaggaguguccauuuauuaaaccggaagugaagcccggcaucccugcacaggagaucgagaugcucaaaaagaauaaaauuuacuucaugcauagacaagacguguuagauaagaaccacgucgccgacauagauaagcugaucgacuaugcugccuccggggauccaaccucucccgacaauauugacagcccuaacgcaccauggguuuuugcuugcgcccccgauagguguccgccuacaugcaucuacguggcgggaauggccgaacuuggugcauucuuuuccauauugcaggacaugcggaauaccauuauggcuucaaaaacgguaggcacugccgaggaaaagcugaaaaagaaaaguagcuucuaccagucuuaucuacgacgcacacaauccauggggauccagcucgaucagagaaucauucugcuuuacaugcuggaguggggaaaggaaaugguggaccauuuccacuugggcgaugacauggaucccgagcucaggggucuggcucaggccuuaaucgaccaaaaggucaaagagauuucaaaccaggaaccacugaagauauga

SEQ ID NO: 5758 - RNA, 1302 nt, Artificial Sequence
  derived and/or modified CDS sequence (opt3) from PUUV(CG17/Baskiria-2001)__AF442613.1__N
augagcgaccuggccgauauccaggaggaaauuaccagacacgagcaacagcucguggcugcaaggcagaaacuuaaagacgccgaacgggcggucgagguugaucccgacgaugugaacaagaauacacugcaggcucgccaacagacuguauccgccuuggaagacaaauuagcagauuacaagcgacguauggccgacgcugugucuagaaagaagauggauacgaagccuaccgacccaacaggcauagagccggaugaccaucugaaagagaggucaagucuacgguaugggaacguccucgaugugaaugcaaucgacauugaagaacccagcggacagacugccgacugguacaccaucgguguuuaugugauuggcuucacaaucccuauaauccugaaggcucuuuacaugcuguccacccgcgggagacagacugucaaagaaaacaagggaacaaggauucgguuuaaagaugacaccucuuucgaggauaucaauggcauucgccgaccaaagcacuuguaugugucgaugcccacggcccaaucaacuaugaaggcggaggaacucaccccugguagauuuaggacaaucguaugcgggcuguucccaacucagauacagguucggaacauuaugagccccgugaugggagucaucggcuuuaguuucuuugugaaagacuggccugagaagauucgugaguucauggagaaagaauguccauuuaucaagccggaggugaaacccggcaccccugcacaggaggucgaguuccugaagcgcaauagaguuuacuuuaugacaaggcaagaugugcucgacaaaaaccauguagccgauaucgacaaguuaauugauuaugcugccuccggggacccaaccucucccgaugacauagaaagcccuaaugcaccauggguguucgcuugcgcccccgaccgguguccgccuacgugcaucuacgucgcgggaauggccgaacugggugcauuuuucuccauucuucaggauaugcgaaacacuaucauggcuucaaagacagugggcaccgccgaggaaaaauugaagaaaaagaguagcuucuaccagucuuaucugcgcagaacucaauccauggggauacagcuagaccagaggauuauccuccuguacaugcuugaguggggaaaagagaugguugaucacuuucaucugggcgacgauauggaccccgaauugcggggucucgcucagucacugaucgaucaaaaggugaaggagauuagcaaucaggaaccauuaaaaaucuga

SEQ ID NO: 5759 - RNA, 1302 nt, Artificial Sequence
  derived and/or modified CDS sequence (opt3) from PUUV(CG215)__AF367066.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguguguauguuauuggcuucacacugccuaucauacuuaaggcucuguacauguuguccacccgcgggagacagacugugaaagagaacaagggaacaaggauccgguuuaaagacgauaccucuuucgaagacauuaauggcauccgccgaccaaagcaccucuaugucucgaugcccacggcccaaucaacuaugaaggcggaggagcugaccccugguagauuuaggacaauugugugcgggcuguucccaacucagauccagguacggaacauaaugagccccguuaugggagugauuggcuuuaguuucuuugucaaagauuggccugaacguauccgcgaguucauggaaaaggaguguccauuuauuaaaccggaagugaagcccggcaccccugcacaggagaucgagaugcucaaaaagaauaaaaucuacuucaugcauagacaagacguguuagauaagaaccacgucgccgacauugauaagcugauagacuaugcugccuccggggauccaacaucucccgacaauaucgacagcccuaacgcaccauggguuuuugcuugcgcccccgauagguguccgccuaccugcauuuacguggcgggaauggccgaacuuggugcauucuuuuccaucuugcaggacaugcggaauacgauaauggcuucaaaaacuguaggcacagccgaggaaaagcugaaaaagaaaaguagcuucuaccagucuuaucuacgacgcacccaauccauggggauucagcucgaucagagaaucauccugcuuuacaugcuggaguggggaaaggaaaugguggaccauuuccacuugggcgaugacauggaucccgagcucaggggucuggcucagacuuuaauugaccaaaaggucaaagagaucucaaaccaggaaccacugaagauuuga

SEQ ID NO: 5760 - RNA, 1302 nt, Artificial Sequence
  derived and/or modified CDS sequence (opt3) from PUUV(CG315)__AF367068.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguguguauguuauuggcuucacacugccuaucauacuuaaggcucuguacauguuguccacccgcgggagacagacugugaaagagaacaagggaacaaggauccgguuuaaagacgauaccucuuucgaagacauuaauggcauccgccgaccaaagcaccucuaugucucgaugcccacggcccaaucaacuaugaaggcggaggagcugaccccugguagauuuaggacaauugugugcgggcuguucccaacucagauccagguacggaacauaaugagccccguuaugggagugauuggcuuuaguuucuuugucaaagauuggccugaacguauccgcgaguucauggaaaaggaguguccauuuaugaaaccggaagugaagcccggcaccccugcacaggagauugagaugcucaaaaagaauaaaaucuacuucaugcauagacaagacguguuagauaagaaccacgucgccgacaucgauaagcugauugacuaugcugccuccggggauccaacaucucccgacaauauagacagcccuaacgcaccauggguuuuugcuugcgcccccgauagguguccgccuaccugcaucuacguggcgggaauggccgaacuuggugcauucuuuuccauuuugcaggacaugcggaauacgaucauggcuucaaaaacuguaggcacagccgaggaaaagcugaaaaagaaaaguagcuucuaccagucuuaucuacgacgcacccaauccauggggauacagcucgaucagagaauuauccugcuuuacaugcuggaguggggaaaggaaaugguggaccauuuccacuugggcgaugacauggaucccgagcucaggggucuggcucaggccuuaaucgaccaaaaggucaaagagauuucaaaccaggaaccacugaagaucuga

SEQ ID NO: 5761 - RNA, 1302 nt, Artificial Sequence
  derived and/or modified CDS sequence (opt3) from PUUV(CRF161)__AF367069.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguguguauguuauuggcuucacacugccuaucauacuuaaggcucuguacauguuguccacccgcgggagacagacugugaaagagaacaagggaacaaggauccgguuuaaagacgauaccucuuucgaagacauuaauggcauccgccgaccaaagcaccucuaugucucgaugcccacggcccaaucaacuaugaaggcggaggagcugaccccugguagauuuaggacaauugugugcgggcuguucccaacucagauccagguacggaacauaaugagccccguuaugggagugauuggcuuuaguuucuuugucaaagauuggccugaacguauccgcgaguucauggaaaaggaguguccauuuauuaaaccggaagugaagcccggcaccccugcacaggagaucgagaugcucaaaaagaauaaaaucuacuucaugcauagacaagacguguuagauaagaaccacgucgccgacauugauaagcugauagacuaugcugccuccggggauccaacaucucccgacaauaucgacagcccuaacgcaccauggguuuuugcuugcgcccccgauagguguccgccuaccugcauuuacguggcgggaauggccgaacuuggugcauucuuuuccaucuugcaggacaugcggaauacgauaauggcuucaaaaacuguaggcacagccgaggaaaagcugaaaaagaaaaguagcuucuaccagucuuaucuacgacgcacccaauccauggggauucagcucgaucagagaaucauccugcuuuacaugcuggaguggggaaaggaaaugguggaccauuuccacuugggcgaugacauggaucccgagcucaggggucuggcucaggccuuaauugaccaaaaggucaaagagaucucaaaccaggaaccacugaagauuuga

SEQ ID NO: 5762 - RNA, 1302 nt, Artificial Sequence
  derived and/or modified CDS sequence (opt3) from PUUV(CRF308)__AF367070.1__N
augagcgaccugaccgauauccaggaggacauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuacaagcgacguauggcagaugccguaucuagaaagaagauggacaccaagccugcugauccaacaggcauagaaccggacgaucaucugaaagagaggucaagucuacgguaugggaacgugcucgacgucaaugcaaucgacauugaggaacccagcggacagacugccgauugguacaccaucgguguguauguuauuggcuucacacugccuaucauacuuaaggcucuguacauguuguccacccgcgggagacagacugugaaagagaacaagggaacaaggauccgguuuaaagacgauaccucuuucgaagacauuaauggcauccgccgaccaaagcaccucuaugucucgaugcccacggcccaaucaacuaugaaggcggaggagcugaccccugguagauuuaggacaauugugugcgggcuguucccaacucagauccagguacggaacauaaugagccccguuaugggagugauuggcuuuaguuucuuugucaaagauuggccugaacguauccgcgaguucauggaaaaggaguguccauuuauuaaaccggaagugaagcccggcaccccugcacaggagaucgagaugcucaaaaagaauaaaaucuacuucaugcauagacaagacguguuagauaagaaccacgucgccgacauggauaagcugauugacuaugcugccuccggggauccaacaucucccgacaauauagacagcccuaacgcaccauggguuuuugcuugcgcccccgauagguguccgccuaccugcaucuacguggcgggaauggccgaacuuggugcauucuuuuccauuuugcaggacaugcggaauacgaucauggcuucaaaaacuguaggcacagccgaggaaaagcugaaaaagaaaaguagcuucuaccagucuuaucuacgacgcacccaauccauggggauacagcucgaucagagaauuauccugcuuuacaugcuggaguggggaaaggaaaugguggaccauuuccacuugggcgaugacauggaucccgagcucaggggucuggcucaggccuuaaucgaccaaaaggucaaagagauuucaaaccaggaaccacugaagaucuga

SEQ ID NO: 5763 - RNA, 1302 nt, Artificial Sequence
  derived and/or modified CDS sequence (opt3) from PUUV(CRF366)__AF367071.1__N
augaccgaccugacagauauccaggaggacauuacuagacacgaacaacagcucguggccgcuaggcagaaacuuaaagaugcagagcgggccgucgaaauggaccccgaugacguuaacaagaauacgcugcaggcgcgccaacagaccgugagcgcuuuggaggauaaauuagccgacuacaagcgacguauggcagaugccguauccagaaagaagauggacacaaagccugcugauccaacuggcauagaaccggacgaucaucugaaagagaggucuucacuacgguaugggaacgugcucgacgucaaugcaaucgacauugaggaacccaguggacagaccgccgauugguacacaaucgguauuuaugugaucggcuucacccugccuauaauccuuaaggcucuguacauguugagcacucgcgggagacagacaguuaaagagaacaagggaaccaggauucgguuuaaagacgauacguccuucgaagacaucaauggcauucgccgaccaaagcaccucuaugugucuaugcccacugcccaaucgaccaugaaggcggaggagcugacaccugguagauuuaggacuaucgucugcgggcuguucccaacccagauacaggugcggaacauuaugucacccguaaugggaguuaucggcuuuagcuucuuugugaaagauuggccugaacguauucgcgaguucauggaaaaggaguguccauuuaucaaaccggaagucaagcccggcaccccugcacaggagaucgagaugcucaaaaagaauaaaauuuacuucaugcauagacaagacguguuagauaagaaccacguggccgacauagauaagcugaucgacuaugcugccaguggggauccaacaucccccgacaauauugacucuccuaacacgccaugggucuuugcaugcgcucccgauagguguccgccuacuugcaucuacguugccggaauggcggaacuuggugccuucuuuagcauauugcaggacaugcggaauacaauuauggcauccaaaaccgugggcacugcugaggaaaagcugaaaaagaaaucaaguuucuaccagagcuaucuacgacgcacacaaucuauggggauccagcucgaucagagaaucauucugcuuuacaugcuggaguggggaaaggaaaugguagaccauuuccacuugggcgaugacauggaucccgagcucaggggucuggcccaggcuuuaaucgaccaaaaggugaaagagauuuccaaccaggaaccacugaagauauga

SEQ ID NO: 5764 - RNA, 1302 nt, Artificial Sequence
  derived and/or modified CDS sequence (opt3) from PUUV(Djaknebole_98-1)__AM746310.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagaggugaaaccgggcacacccacccaggaaaucgaguuucucaagaaaaauaaggucuauuucauggaucgccaaaacguuuuagacaagaaucauguggcggauaucgacaaacugauugauuacgcagccaguggggacccuacgucuccagacaacauagagagccccaaugcuccuuggguauuugccugcgcaccagauagaugucccccgacuugcaucuauguggcuggaauggccgaacuuggugcguucuucuccauuuugcaggacaugaggaacacaaucauggccucaaagaccgucggcacugcagaggaaaaacugaagaaaaagaguagcuuuuaccagucuuaccuacggcgaacacaauccauggggauacagcucgaucagcgcauuauccugcuuuauaugcuggaguggggaaaggaaaugguggaccacuuccauuugggcgaugacauggauccugagcucagaggucuggcucaggccuuaaucgaccaaaaaguuaaggagauuucaaaucaggauccccugaaaaucuga

SEQ ID NO: 5765 - RNA, 1302 nt, Artificial Sequence
  derived and/or modified CDS sequence (opt3) from PUUV(Fusong 114-05)__EF488804.1__N
augagcgaccugaaggauauccaggaggacauugccagacacgaacaacagcucguggucgcuaggcagaaacuucgggaugcagagaaggccguugaaauggaccccgaugacgugaacaaaaauacccugcaggcgcgccaacagacaguauccgcuuuggaggauaagauagccgacuucaaacgacguauggcagauaucgugucuagaaagaagauggacacuaaaccugccgauccaacgggcauugaaccggacgaucauuuaaaggagaggucaagucugcgguacgggaacguccuagacgugaaugcuaucgacauugaggaacccagcggacagaccgcagauugguauacaaucgguguuuacauaaucgaguuuacucucccuauuauccugaaagcccuuuauaugcuguccacccgcggcagacagacagcuaaggaaaacaaagggaccaggauucgguucaaggacgauacuucuuuugaggacgugaauggaauccgccgaccaaagcacuuguacgucucgaugcccacagcccaaucaaccaugaaagcggaggaacucacgccuggcagauucaggacuauagugugcggucuguuuccaacccagauucagguacggaacaucaugagccccguuaugggggugauuggauucuccuuuuucgcaaaggauuggccugaccguaucaaagaguuuauggaaaaggaguguccauucaucaaaccggaagucaagcccggcacacccgccaaagagguggagauucugaagcgcaauaagauauauuuuaugcagagacaaggcgugcucgauaaaaaccaugucccagacaucgauaaguuaauugacuacgcugccaguggggaucccacuucuccuaggaauaucgacagcccaaacgcacccuggguuuucgcuugcgccccggaccgguguccuccuaccugcauauauguggcgggaauggccgaacugggugcauuuuucuccauucuucaggauaugcgaaauacaaucauggcuucaaaaaccguaggcacggccgaggaaaaguugaaaaagaagaguagcuucuaccagucuuaccugcgcagaacucaauccauggggauccagcuagaccagaggauuauccuccuguauaugcuugaguggggaaaagaaaugguggaucacuuucaucugggcgacgauauggacccagaguugcggucacucgcucaggcccugauugaucaaaaggucaaagagauaagcaaccaggaaccuuuaaagaucuga

SEQ ID NO: 5766 - RNA, 1302 nt, Artificial Sequence
  derived and/or modified CDS sequence (opt3) from PUUV(Fusong 199-05)__EF488803.1__N
augagcgaccugaaggauauccaggaggacauugccagacacgaacaacagcucguggcugcaaggcagaaacuucgggaugccgagaaggcggucgaaauggaccccgaugacguuaacaaaaauacccugcaggcucgccaacagacaguguccgccuuggaggauaagauagcagacuucaaacgacguauggccgauaucguaucuagaaagaagauggacacuaaaccugcugauccaacgggcauugaaccggacgaucauuuaaaggagaggucaagucugcgguacgggaacgugcuagacgucaaugcaaucgacauugaggaacccagcggacagaccgccgauugguauacaaucgguguguacauaaucggcuuuacucucccuauuauccugaaagcucuuuauaugcuguccacccgcgggagacagacaguuaaggagaacaaaggaaccaggauucgguucaaggacgauacuucuuuugaagacgugaauggcauccgccgaccaaagcacuuguacgucucgaugcccacagcccaaucaaccaugaaagcggaggagcucacgccugguagauucaggacuauagugugcgggcuguuuccaacccagauucagguacggaacaucaugagccccguuaugggagugauuggcuucuccuuuuucgcaaaggauuggccugaccguaucaaagaauuuauggagaaggaauguccauucaucaaaccggaggucaagcccggcacacccgccaaagaaguggagauucugaagcgcaauaagauauauuuuaugcagagacaagaugugcucgacaaaaaccaugucccagauaucgacaaguuaauugauuacgcugccaguggggaccccacuucuccugagaauaucgacagcccaaacgcacccuggguuuucgcuugcgccccggauagguguccuccuaccugcauauauguggcgggaauggccgaacugggugcauuuuucuccauucuucaggacaugcggaauacaaucauggcuucaaaaaccguaggcacggccgaggaaaaguugaaaaagaagaguagcuucuaccagucuuaccugcgacgcacucaauccauggggauccagcuagaucagagaauuauccuccuguauaugcuugaguggggaaaagaaaugguggaccacuuucaucugggcgaugacauggauccagaguugaggucacucgcucaggcccugauugaccaaaaggucaaagagauaagcaaccaggaaccuuuaaagaucuga

SEQ ID NO: 5767 - RNA, 1302 nt, Artificial Sequence
  derived and/or modified CDS sequence (opt3) from PUUV(Fusong 200-05)__EF211820.1__N
augagcgaccugaaggauauccaggaggacauugccagacacgaacaacagcucguggucgcuaggcagaaacuucgggaugcagagaaggccguugaaauggaccccgaugacgugaacaaaaauacccugcaggcgcgccaacagacaguauccgcuuuggaggauaagauagccgacuucaaacgacguauggcagauaucgugucuagaaagaagauggacacuaaaccugccgauccaacgggcauugaaccggacgaucauuuaaaggagaggucaagucugcgguacgggaacguccuagacgugaaugcuaucgacauugaggaacccagcggacagaccgcagauugguauacaaucgguguuuacauaaucggcuuuacucucccuauuauccugaaagcccuuuauaugcuguccacccgcgggagacagacagugaaggagaacaaaggaaccaggauucgguucaaggacgauacuucuuuugaagacgucaauggcauccgccgaccaaagcacuuguacgugucgaugcccacagcucaaucaaccaugaaagccgaggagcucacgccugguagauucaggacuauaguaugcgggcuguuuccaacccagauucagguucggaacaucaugagccccgugaugggagucauuggcuucuccuuuuucgcgaaggauuggccugaccguaucaaagaauuuauggagaaggaauguccauucaucaaaccggaggugaagcccggcacacccgcaaaagaaguggagauucugaagcgcaauaagauauauuuuaugcagagacaagauguccucgacaaaaaccauguuccagauaucgacaaguuaauugauuacgccgcuaguggggaccccacuucuccugagaauaucgacagcccaaacgcccccuggguguucgcaugcgcuccggauagguguccuccuaccugcauauauguagccggaauggcggaacugggugccuuuuucuccauucuucaggacaugcggaauacaaucauggcaucaaaaaccgugggcacggcugaggaaaaguugaaaaagaagaguagcuucuaccagucuuaccugcgacgcacucaauccauggggauccagcuagaucagagaauuauccuccuguauaugcuugaguggggaaaagaaauggucgaccacuuucaucugggcgaugacauggauccagaguugaggucacucgcccaggcucugauugaccaaaaggugaaagagauaagcaaccaggaaccuuuaaagaucuga

SEQ ID NO: 5768 - RNA, 1302 nt, Artificial Sequence
  derived and/or modified CDS sequence (opt3) from PUUV(Fusong 900-06)__EF488806.1__N
augagcgaccugaaggauauccaggaggacauugccagacacgaacaacagcucguggucgcuaggcagaaacuucgggaugcagagaaggccguugaaauggaccccgaugacgugaacaaaaauacccugcaggcgcgccaacagacaguauccgcuuuggaggauaagauagccgacuucaaacgacguauggcagauaucgugucuagaaagaagauggacacuaaaccugccgauccaacgggcauugaaccggacgaucauuuaaaggagaggucaagucugcgguacgggaacguccuagacgugaaugcuaucgacauugaggaacccagcggacagaccgcagauugguauacaaucgguguuuacauaaucggcuuuacucucccuauuauccugaaagcccuuuauaugcuguccacccgcgggagacagacagugaaggagaacaaaggaaccaggauucgguucaaggacgauacuucuuuugaagacgucaauggcauccgccgaccaaagcacuuguacgugucgaugcccacagcucaaucaaccaugaaagccgaggagcucacgccugguagauucaggacuauaguaugcgggcuguuuccaacccagauucagguucggaacaucaugagccccgugaugggagucauuggcuucuccuuuuucgcgaaggauuggccugaccguaucaaagaauuuauggagaaggaauguccauucaucaaaccggaggugaagcccggcacacccgcaaaagaaguggagauucugaagcgcaauaagauauauuuuaugcagagaagggauguccucgacaaaaaccauguuccagauaucgacaaguuaauugauuacgccgcuaguggggaccccacuucuccugagaauaucgacagcccaaacgcccccuggguguucgcaugcgcuccggaucgguguccuccuaccugcauauauguagccggaauggcggaacugggugccuuuuucuccauucuucaagacaugcgaaauacaaucauggcaucaaaaaccgugggcacggcugaggaaaaguugaaaaagaagaguagcuucuacaaaucuuaccugcgcagaacucaguccauggggauccagcuagaucaaaggauuauccuccuguauaugcuugaguggggaaaggaaauggucgaccacuuucaucugggcgaugacauggauccagaguugcggucacucgcccaggcucugauugaccagaaagugaaggagauaagcaaccaggaaccuuuaaaaaucuga

SEQ ID NO: 5769 - RNA, 1302 nt, Artificial Sequence
  derived and/or modified CDS sequence (opt3) from PUUV(Gumboda_98-2)__AM746316.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagaggugaaaccgggcacacccacccaggaaaucgaguuucucaagaaaaauaaggucuauuucauggaucgccaaaacguuuuagagaagaaucauguggcggacaucgauaaacugauugacuacgcagccaguggggauccuacgucuccagacaacauagaaagccccaaugcuccuuggguauuuuccugcgccccagacagaugucccccgacuugcaucuauguggcaggaauggcugagcuuggugccuucuucucaauuuugcaggauaugaggaacacaaucauggcgaguaagaccgucggcacugccgaagagaaacugaagaaaaagagcucuuuuuaccaguccuaccuacggcgaacacaaucaauggggauacagcucgaccagcgcauuauccugcuuuauaugcuggaauggggaaaggagaugguggaucacuuccauuugggcgacgauauggacccugagcucagaggucuggcacaggcuuuaaucgaucaaaaaguuaaggaaauuagcaaucaggacccccugaaaaucuga

SEQ ID NO: 5770 - RNA, 1302 nt, Artificial Sequence
  derived and/or modified CDS sequence (opt3) from PUUV(Gumboda_98-4)__AM746318.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagaggugaaaccgggcacacccacccaggaaaucgaguuucucaagaaaaauaaggucuauuucauggaucgccaaaacguuuuagacaagaaucauguggcggauaucgacaaacugauugauuacgcagccaguggggacccuacgucuccagacaacauagagagccccaaugcuccuuggguauuuuccugcgccccagauagaugucccccgacuugcaucuauguggcaggaauggcugaacuuggugccuucuucucaauuuugcaggacaugaggaacacaaucauggcgaguaagaccgucggcacugccgaggaaaaacugaagaaaaagagcucuuuuuaccaguccuaccuacggcgaacacaaucaauggggauacagcucgaucagcgcauuauccugcuuuauaugcuggaguggggaaaggaaaugguggaccacuuccauuugggcgaugacauggauccugagcucagaggucuggcacaggcuuuaaucgaccaaaaaguuaaggagauuagcaaucaggauccccugaaaaucuga

SEQ ID NO: 5771 - RNA, 1302 nt, Artificial Sequence
  derived and/or modified CDS sequence (opt3) from PUUV(Kamiiso-8Cr-95)__AB010730.1__N
augagcgaccugaaggauauccaggaggacauuaccagacacgaacaacagcucguggucgccaggcagaaacuucgggaugcugagaaggcaguugaaauggaccccgaugacgugaacaaaaauacacugcaggcccgccaacagacuguauccgcguuggaggauaaguuagcugacuucaaacgacguauggccgauguggucucuagaaagaagauggacacgaaaccugcagauccaaccggcauagaaccggacgaucaucugaaggagaggucaagucuacgguacgggaacgugcucgacguuaaugccaucgacauugaggaacccagcggacagacagcugauugguauacuaucgguguguacauuaucggcuuuacccugccuauaauccuuaaagcacuguauauguuguccacacgcgggagacagaccgucaaggagaacaaaggaacuaggauucgguucaaggacgauacaucuuuugaagacaucaauggcauucgccgaccaaagcaccucuacgugucgaugcccaccgcccaaucaacgaugaaagcugaggagaucacuccugguagauucaggaccauaguaugcgggcuguuuccaacacagauucagguucggaacaucaugagccccgugaugggagucauuggcuucuccuuuuucgugaaggauuggccugaacguaucaaagaguuuauggaaaaggaguguccauucaucaaaccggaagugaagcccggcacuccugccaaagaggucgagauucugaagcgcaauaagguuuauuuuaugcagagacaagacgugcucgauaaaaaccauguaccagacauagauaaguuaaucgacuacgcggcaaguggggaucccaccucuccugacaauauugacagcccaaacgcccccuggguguucgcuugcgccccggauagguguccucccacaugcaucuaugucgcaggaauggcugaacugggugccuuuuucuccauacuucaggacaugcggaauaccauuauggcgucaaaaacggugggcacugccgaggaaaaguugaaaaagaagaguagcuucuaccagucuuaccugcgacgcacacaauccauggggauccagcuagaucagagaaucauucuccuguauaugcuugaguggggaaaagaaaugguugaccacuuucaucugggcgaugacauggauccagaguugaggggucucgcacaggcucugaucgaccaaaaggugaaagagauuucaaaccaggaaccuuuaaagauauga

SEQ ID NO: 5772 - RNA, 1302 nt, Artificial Sequence
  derived and/or modified CDS sequence (opt3) from PUUV(Mu/07/1219)__KJ994776.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuuauuaagccagaagugaaaccgggcacacccgcgcaggaggcagaguuccucaagcgcaauaaagucuacuuuaugcaaagacaggacguuuuagauaagaaccauguggccgacaucgauaagcugaucgacuaugcugccuccggggauccuaccucuccagacaauauugaaagccccaacgcaccuuggguauucgcuugcgccccagacaggugucccccgacgugcauauacguggcgggaauggccgagcuuggugcauuuuucuccaucuugcaggauaugcggaauacuauuauggcuucaaaaacagucggcaccgccgaagagaagcugaaaaagaaaaguagcuucuaccaaucuuaucuacgacgcacucaguccauggggauccagcucgaccagagaauaauucugcuuuacaugcuggaauggggaaaggagaugguggaucacuuucauuugggcgacgauauggacccugagcucaggggucuggcucaagccuuaaucgaucagaagguuaaagaaaucucaaaccaggagccccugaagauuuga

SEQ ID NO: 5773 - RNA, 1302 nt, Artificial Sequence
  derived and/or modified CDS sequence (opt3) from PUUV(Opina916)__AF294652.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccugucgauccaacaggcauagaaccggacgaucaucugaaggagagaucaagucuaagguacgggaacgugcucgacguuaaugccaucgacauugaggaacccagcggacagacugcugauugguauaccaucgguguguacgucauuggcuuuacacugccuaucauacuuaaagcacuguauauguuguccacccgggggcgccagacugugaaggagaacaaaggaacaagaaucagguucaaggacgauaccucuuuugaagacauuaauggcauccggcgcccaaagcaccucuacguaucgaugcccacggcccaaucaacuaugaaagcugaggagcugaccccuggucgauucagaacaauuguuugcgggcuguuuccaacucagauccaggugaggaacauaaugagccccgucaugggagugauuggcuucuccuuuuucgugaaggauugggccgaacggauccgugaguuuauggaaaaagaguguccuuucauuaagccagaagucaaaccgggcacccccgcgcaggaggcagaguuucucaagaaaaaucgcaucuauuucaugcaaagacaggaaguuuuagacaagaaccauguggccgauaucgacaagcugauugauuacgcugccaguggggacccuacaucuccagauaauauagagagccccaacgcaccuuggguauuugcuugcgccccagacaggugucccccgaccugcaucuauguggcgggaauggccgaacuuggugcauucuucuccauuuugcaggacaugcggaauacgaucauggcuucaaaaacugucggcacagccgaggaaaagcugaaaaagaaaaguagcuuuuaccaaucuuaccuacgacgcacccaguccauggggauacagcucgaucagagaauuauccugcuuuauaugcuggaguggggaaaggagaugguggaccacuuccauuugggcgaugacauggauccugaacucaggggucuggcucaagccuuaaucgaccagaagguuaaagagauuucaaaccaggaaccccugaagaucuga

SEQ ID NO: 5774 - RNA, 1302 nt, Artificial Sequence
  derived and/or modified CDS sequence (opt3) from PUUV(Palbole_98-1)__AM746327.1__N
augagcgaccugaccgauauccaggaggacauuacaugccacgaacaacagcucguggucgccagacagaaacuuaaggaugcugagaaggcaguugaaauggaccccgaugacgugaacaaaaauacucugcaggccaggcaacagacgguauccgcguuggaggauaaguuagcugacuucaaacggcgcauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcagacagucaaggagaacaaaggaacccgcaucagauucaaggacgauacgucuuuugaagacauuaauggcaucaggcggccaaagcaccucuacgugucgaugcccacugcccaaucaaccaugaaagcugaggagcugacaccuggucgcuuccgaacuauuguaugugggcuguuuccaacccagauccagguuagaaacauaaugagccccgugaugggagucauuggcuucuccuuuuucgugaaggauugggccgacaggauccgggaauuuauggagaaagaaugcccuuucauuaagccagaggugaaaccgggcacacccacccaggaaaucgaguuucucaagaaaaauaaggucuauuucauggaucgucaaaacguuuuagacaagaaucauguggcggauaucgacaaacugauugauuacgcagccaguggggacccuacgucuccagacaacauagagagccccaaugcuccuuggguauuugccugugcaccagaucgcugucccccgacuugcaucuauguggcuggaauggccgaacuuggugcguucuucuccauuuugcaggacaugagaaacacaaucauggccucaaagaccgucggcacugcagaggaaaaacugaagaaaaagaguagcuuuuaccagucuuaccuaaggcggacacaauccauggggauacagcucgaucagcgaauuauccugcuuuauaugcuggaguggggaaaggaaaugguggaccacuuccauuugggcgaugacauggauccugagcuccgcggucuggcucaggccuuaaucgaccaaaaaguuaaggagauuucaaaucaggauccccugaaaaucuga

SEQ ID NO: 5775 - RNA, 1302 nt, Artificial Sequence
  derived and/or modified CDS sequence (opt3) from PUUV(Palbole_98-2)__AM746328.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagaggugaaaccgggcacacccacccaggaaaucgaguuucucaagaaaaauaaggucuauuucauggaucgccaaaacguuuuagacaagaaucauguggcggauaucgacaaacugauugauuacgcagccaguggggacccuacgucuccagacaacauagagagccccaaugcuccuuggguauuugccugcgcaccagauagaugucccccgacuugcaucuauguggcuggaauggccgaacuuggugcguucuucuccauuuugcaggacaugaggaacacaaucauggccucaaagaccgucggcacugcagaggaaaaacugaagaaaaagaguagcuuuuaccagucuuaccuacggcgaacacaauccauggggauacagcucgaucagcgcauuauccugcuuuauaugcuggaguggggaaaggaaaugguggaccacuuccauuugggcgaugacauggauccugagcucagagguuuugcucaggcccugaucgaccaaaaaguuaaggagauuucaaaucaggaucccuuaaaaaucuga

SEQ ID NO: 5776 - RNA, 1302 nt, Artificial Sequence
  derived and/or modified CDS sequence (opt3) from PUUV(Palbole_98-3)__AM746329.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagaggugaaaccgggcacacccacccaggaaaucgaguuucucaagaaaaauaaggucuauuucauggaucgccaaaacguuuuagacaagaaucauguggcggauaucgacaaacugauugauuacgcagccaguggggacccuacgucuccagacagcauagagucccccaacgcuccuuggguauuugccugcgcaccagauagaugucccccgacuugcaucuauguggcuggaauggccgaacuuggugcguucuucucaauuuugcaggacaugaggaauacaaucauggccaguaagaccgucggcacugcagaggaaaaacugaagaaaaagagcucuuuuuaccaguccuaccuacggcgaacacaaucaauggggauacagcucgaucagcgcauuauccugcuuuauaugcuggaguggggaaaggaaaugguggaccacuuccauuugggcgaugacauggauccugagcucagaggucuggcucaggccuuaaucgaccaaaaaguuaaggagauuagcaaccaggauccccugaaaaucuga

SEQ ID NO: 5777 - RNA, 1302 nt, Artificial Sequence
  derived and/or modified CDS sequence (opt3) from PUUV(PUUV/Ardennes/Mg156/2011)__KT247592.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccgcgcaagaagucgaguuucucaagcguaauaaaaucuauuucaugcagcgccaggauguuuuagacaagaaccauguggcagauaucgacaagcugauugauuacgccgcuaguggggacccuaccucuccagacaauauagaggcccccaacgcaccuuggguauuugcuugcgccccagauagaugucccccgacgugcaucuauguggcgggaauggccgaacuuggugcauucuucagcauuuugcaagacaugaggaauacuaucauggcuuccaaaacagucggcaccgccgaggaaaagcugaaaaagaaaucaaguuuuuaccagagcuaccuacggcgaacucagucuauggggauacagcucgaucaacgcauuauccugcuuuauaugcuggaguggggaaaggaaaugguggaccacuuccauuugggcgaugacauggauccugagcucagaggucuggcucaggccuuaaucgaccagaagguuaaagagauuuccaaccaggaaccccugaagaucuga

SEQ ID NO: 5778 - RNA, 1302 nt, Artificial Sequence
  derived and/or modified CDS sequence (opt3) from PUUV(PUUV/Jelgava/Mg136/2008)__JN657230.1__N
augagcgaccuggccgauauccaggaggacauuaccagacacgaacaacagcucguggucgcuaggcagaaacuuaaagaugcagagcgggccguugaaguggaccccgaugacguaaacaagaauacacugcaggcgcgccaacagacuguguccgcuuuggaggauaaauuagccgacuacaagcgacguauggcagaugccgucucuagaaagaagauggacacgaagccugcugauccaaccggcauagaaccggacgaucaucugaaagagaggucaagucuacgguaugggaacgugcucgacguuaaugcaaucgacauugaggaacccagcggacagacagccgauugguacacuaucgguguguaugucauuggcuucacccugccuaucauacuuaaggcucuguacauguuguccacacgcgggagacagaccgugaaagagaacaagggaacuaggauccgguuuaaagacgauacaucuuucgaagacauuaauggcauccgccgaccaaagcaccucuauguaucgaugcccaccgcccaaucaacgaugaaggcggaggagcugacuccugguagauuuaggaccguugugugcgggcuguucccaacacagauucagguccggaacaucaugagccccgugaugggagugauaggcuuuaguuucuuugucaaagauuggccugaccguauuaaggaguucauggaaaaagaauccccauuuaucaagccggauguuaaacccggcacuccugcacaggagguggaguuccucaagcgcaauaaaguauacuuuaugaacagacaagacguguuagauaagaaucaugucgccgacauugauaagcugaucgacuaugcugccucuggggacccaaccagccccgaugacaucgaauccccuaacgcaccauggguguucgcuugugcccccgauaggugcccgccuacauguauuuacguugcgggaauggccgagcuuggugcauuuuucucaauauugcaggacaugcggaauaccaucauggcuaguaaaacggugggcacugccgaagagaagcugaaaaagaaaagcucuuucuaccaguccuaucuacgacgcacacaaucaauggggauucagcucgaucagagaaucauacugcuuuacaugcuggaauggggaaaggagauggucgaccacuuucauuugggcgaugacauggaucccgaacucaggggucuggcucaggccuuaauugaccaaaaggugaaagagaucagcaaccaggagccacugaagaucuga

SEQ ID NO: 5779 - RNA, 1302 nt, Artificial Sequence
  derived and/or modified CDS sequence (opt3) from PUUV(PUUV/Jelgava/Mg140/2008)__JN657231.1__N
augagcgaccuggccgauauccaggaggacauuaccagacacgaacaacagcucguggucgcuaggcagaaacuuaaagaugcagagcgggccguugaaguggaccccgaugacguaaacaagaauacacugcaggcgcgccaacagacuguguccgcuuuggaggauaaauuagccgacuacaagcgacguauggcagaugccgucucuagaaagaagauggacacgaagccugcugauccaaccggcauagaaccggacgaucaucugaaagagaggucaagucuacgguaugggaacgugcucgacguuaaugcaaucgacauugaggaacccagcggacagacagccgauugguacacuaucgguguguaugucauuggcuucacccugccuaucauacuuaaggcucuguacauguuguccacacgcgggagacagaccgugaaagagaacaagggaacuaggauccgguuuaaagacgauacaucuuucgaagacauuaauggcauccgccgaccaaagcaccucuauguaucgaugcccaccgcccaaucaacgaugaaggcggaggagcugacuccugguagauuuaggaccguugugugcgggcuguuccauacacagauucagguccggaacaucaugagcccagugaugggagugauaggcuuuaguuucuuugucaaagauuggcccgaccguauuaaggaguucauggaaaaagaauguccuuuuaucaagccagauguuaaaccgggcacucccgcacaggagguggaguuccucaagcgcaauaaaguauacuuuaugaacagacaagacguguuagauaagaaucacgucgccgacauugauaagcugaucgacuaugcugccuccggggacccuaccucuccagaugacaucgaaagccccaacgcaccuuggguguucgcuugcgccccagauaggugucccccgacaugcauuuacguugcgggaauggccgagcuuggugcauuuuucuccauauugcaggacaugcggaauaccaucauggcuucaaaaacggugggcacugccgaagagaagcugaaaaagaaaaguagcuucuaccagucuuaucuacgacgcacacaauccauggggauucagcucgaucagagaaucauacugcuuuacaugcuggaauggggaaaggagauggucgaccauuuucacuugggcgaugacauggauccugaacucaggggucuggcucaggccuuaauugaccaaaaggugaaagagaucucaaaccaggagccccugaagaucuga

SEQ ID NO: 5780 - RNA, 1302 nt, Artificial Sequence
  derived and/or modified CDS sequence (opt3) from PUUV(PUUV/Jura/Mg2/2010)__KT247596.2__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaccggauccgugaauuuauggagaaagaauguccuuucauuaagccagagaucaaaccgggcacacccgcgcaggaagcagaguuucucaagcgcaauaaaaucuauuucaugcaaagacaggauguguuagacaagaaccaugucgccgauauugacaagcugauagauuacgcugccaguggggacccuaccucuccagacaauaucgagagccccaacgcaccuuggguuuuugcuugcgccccagauaggugucccccgacgugcauuuauguggcgggaauggccgaacuuggugcauucuucuccaucuugcaggacaugcggaauacuauaauggcuucaaaaacaguaggcaccgccgaggaaaagcugaaaaagaaaaguagcuuuuaccaaucuuaccuacgacgcacucaguccauggggauucagcucgaucagagaaucauccugcuuuauaugcuggaguggggaaaggaaaugguggaccacuuccauuugggcgaugacauggauccugagcucaggggucuggcucaagccuuaauugaccagaaggucaaagagaucucaaaccaggaaccccugaagauuuga

SEQ ID NO: 5781 - RNA, 1302 nt, Artificial Sequence
  derived and/or modified CDS sequence (opt3) from PUUV(PUUV/Madona/Mg233/2008)__JN657232.1__N
augagcgaccuggccgauauccaggaggacauuaccagacacgaacaacagcucguggucgcuaggcagaaacuuaaagaugcagagcgggccguugaaguggaccccgaugacguaaacaagaauacacugcaggcgcgccaacagacuguguccgcuuuggaggauaaauuagccgacuacaagcgacguauggcagaugccgucucuagaaagaagauggacacgaagccuaccgauccaacaggcauagaaccggacgaucaucugaaagagaggucaagucuacgguaugggaacgugcucgacguuaaugcuaucgacauugaggaacccagcggacagacugcagauugguacaccaucgguguguaugucauuuccuucacacugccuaucauacuuaaggcccuguacauguugucuacccgcggcagacagacugugaaagagaacaaggggacaaggauccgguuuaaagacgauaccucguucgaagacauuaauggaauccgccgaccaaagcaccucuauguaucaaugcccacggcucaaagcacuaugaaggccgaggagcugaccccuggcagauuuaggacaauuguuugcggucuguucccaacucagauccaggugcggaacauaaugagucccgucaugggggugauuggauuuuccuucuuugugaaagauuggccugaccguaucaaggaguucauggaaaaagaauguccauuuauuaagccggaugucaaacccggcaccccugcgcaggagaucgaguuccucaagcgcaauaaaguuuacuuuaugaacagacaagacguguuagauaagaaucauguagcagacaucgauaagcugauugacuaugccgcuucuggcgacccaacaagccccgaugacauagaauccccuaacgccccauggguguucgcaugcgcucccgauagguguccgccuaccugcaucuacgucgccgggauggcggagcuuggagccuuuuucucaauuuugcaggacaugcggaauacgaucauggcaaguaaaacuguggguacagcugaagagaagcugaaaaagaaaagcucuuucuaccaguccuaucuacgacgcacccaaucaaugggcauacagcucgaucagagaauuauccugcuuuacaugcuggaaugggggaaggagaugguugaccacuuucauuugggagaugacauggaucccgaacucaggggccuggcccaggcuuuaaucgaccaaaaggugaaagagauuagcaaccaggagccacugaagaucuga

SEQ ID NO: 5782 - RNA, 1302 nt, Artificial Sequence
  derived and/or modified CDS sequence (opt3) from PUUV(PUUV/Orleans/Mg23/2010)__KT247594.1__N
augagcgaccugaccgauauccaggaggugauuacaagacacgaacaacagcucgucguugccaggcagaaacuuaaggacgcugagaaggcaguggaaauggaucccgacgauguaaacaaaaauacucugcaggcccggcaacagacgguguccgcguuggaggacaaguuagcugauuucaaacgccgaauggccgacgcagucucucguaagaagauggauaccaaaccugccgacccaacaggcauagaaccggaugaccaucugaaggagagaucaagucuaagguacgggaacgugcucgauguuaaugcuaucgacauugaggaacccagcggacagacugcagacugguauaccaucgguguguacgucauuggcuuuacacugccuaucauacuuaaagcccuguauauguuguccacccgggggcgccagacugugaaggagaacaaaggaacaagaaucagguucaaggaugacaccucuuuugaagauauuaauggcauccggcgcccaaagcaccucuacguaucgaugcccacggcucaaucaacuaugaaagccgaggagcugaccccuggucgauucagaacaauuguuugcgggcuguuuccaacucagauccaggugaggaacauaaugagccccgucaugggagugauuggcuucuccuuuuucgugaaggacugggcggaucggaucaaagaauuuauggagaaggaauguccuuucauuaaaccagaggucaagccgggcacccccguuaaagaagcagaguuucucaagaagaaucguguguauuucaugcagcgccaagacguauuagauaaaaaccauguggccgacaucgauaagcugaucgacuacgcugccgcaggggauccuacaaguccagacaauauugagucucccaacgcuccuugggucuuugccugcgcgccagacagaugucccccgaccugcauauauguggccggaauggcagaacuuggugcuuucuucagcaucuugcaggauaugaggaauacgauuauggccuccaaaacuguuggcacagcugaggaaaagcugaaaaagaagucaaguuuuuaccagagcuaccuacggcgaacccaaucuauggggauccagcucgaccagcgcauaauucugcuuuauaugcuggaguggggaaaagaaaugguggaucacuuccauuugggcgacgauauggacccugagcucagaggucuggcccaggcauuaaucgaucaaaaggucaaagagaucuccaaccaggaaccccugaagauuuga

SEQ ID NO: 5783 - RNA, 1302 nt, Artificial Sequence
  derived and/or modified CDS sequence (opt3) from PUUV(Tobetsu-60Cr-93)__AB010731.1__N
augagcgaccugaaggauauccaggaggacauuaccagacacgaacaacagcucguggucgccaggcagaaacuucgggaugcugagaaggcaguugaaauggaccccgaugacgugaacaaaaauacacugcaggcccgccaacagacuguauccgcguuggaggauaaguuagcugacuucaaacgacguauggccgauguggucucuagaaagaagauggacacgaaaccugcagauccaaccggcauagaaccggacgaucaucugaaggacaggucaagucuacgguacgggaacgugcucgacguuaaugccaucgauauugaggagcccagcggacagacagcugacugguauacuaucgguguguacauuaucggcuuuacccugccuauaauccuuaaagcacuguauauguuguccacacgcgggagacagaccgucaaggaaaacaaaggaacuaggauucgguucaaggaugacacaucuuuugaggauaucaauggcauucgccgaccaaagcaccucuacgugucgaugcccaccgcccaaucaacgaugaaagcugaagagaucacuccugguagauucaggaccauaguaugcgggcuguuuccaacacagauucagguucggaacaucaugagccccgugaugggagucauuggcuucuccuuuuucgugaaggacuggccugagcguaucaaagaauuuauggagaaggaauguccauucaucaaaccggaggugaagcccggcacuccugccaaagaagucgagauucugaagcgcaauaagguuuauuuuaugcagagacaagaugugcucgacaaaaaccauguaccagauauagacaaguuaaucgauuacgcggcaaguggggaccccaccucuccugacaauauugauagcccaaacgcccccuggguguucgcuugcgccccggacagguguccucccacaugcaucuaugucgcaggaauggcugagcugggugccuuuuucuccauacuucaggauaugcggaauaccauuauggcgucaaaaacggugggcacugccgaagagaaguugaaaaagaagaguagcuucuaccagucuuaccugcgacgcacacaauccauggggauccagcuagaccagagaaucauucuccuguauaugcuugaauggggaaaagagaugguugaucacuuucaucugggcgacgauauggacccagaauugaggggucucgcacaggcucugaucgaucaaaaggugaaagagauuucaaaccaggagccuuuaaagauauga

SEQ ID NO: 5784 - RNA, 1302 nt, Artificial Sequence
  derived and/or modified CDS sequence (opt3) from PUUV(Vranica)__U14137.1__N
augagcgaccugaccgauauccaggaggacauuacaagacacgaacaacagcucguggucgccaggcagaaacuuaaggaugcugagaaggcaguugaaauguaccccgacgaugugaacaaaaauacucugcaggcccggcaacagacgguauccgcguuggaggacaaguuagcugauuucaaacgccgaauggccgacgcagugucucguaagaagauggauaccaaaccuacagacccaacuggcauagaaccggaugaccaucugaaggagagaucaagucuaagguaugggaacguccucgaugugaaugccaucgacauugaggaacccagcggacagaccgcugacugguacacaaucgguguuuaugugauuggcuuuacccugccuaucauacuuaaagcacuguacauguuguccacucgggggcgccagacagucaaggagaacaaaggaaccagauauagguucaaggaugacacgucuuuugaagauaucaauggcauucggcgcccaaagcaccucuacgugucgaugcccacugcccaaucaaccaugaaagcugaggagcugacaccuggucgauucagaacuaucguaugcgggcuguuuccaacccagauucagguuaggaacaucaugagccccgugaugggagucauaggcuucuccuuuuucgugaaggacugggccgaucggauucgugaauuuauggagaaagaauguccuuucaucaagccagaggugaaaccgggcacacccacccaggaaauugaguuucucaagaaaaauaaggucuauuucauggaccgccaaaacguuuuagauaagaaucauguggcggacaucgauaaacugaucgacuacgcagccaguggggauccuacgucuccagacaacauugagagccccaaugcuccuuggguauuugccugcgcaccagacagaugucccccgacuugcauauacguggcuggaauggccgaacuuggugcguucuucuccaucuugcaggauaugaggaacacaauuauggccucaaagaccgucggcacugcagaggaaaaacugaagaaaaagaguagcuuuuaucagucuuaccuacggcgaacacaauccauggggauccagcucgaccagcgcauaauucugcuuuauaugcuggaguggggaaaggaaaugguggaucacuuccauuugggcgacgauauggacccugagcucagaggucuggcucaggccuuaaucgaucaaaaaguuaaggagaucucaaaucaggacccccugaaaauuuga

SEQ ID NO: 5785 - RNA, 1302 nt, Artificial Sequence
  derived and/or modified CDS sequence (opt3) from PUUV(P360)__L11347.1__N
augagcgaccugaccgauauccaggaggaaauuacaagacacgagcaacagcucguggucgccaggcagaaacuuaaagacgcugaacgggcaguugagguguaccccgaugacguaaacaagaauacucugcaggcccgccaacagacgguguccgcguuggaagauaaauuagcugacuauaagcgacguauggccgaugcagucucuagaaagaagauggacaccaagccuacagauccaacuggcauagagccggacgaucaucugaaagagaggucaagucuacgguacgggaacgugcucgacguuaaugccaucgauauugaagaacccagcggacagaccgcugacugguauacaaucgguguguacgucauuggcuucaccaucccuauaauccugaaggcacuuuauaugcuguccacucgcgggagacagacagugaaagaaaacaagggaaccaggauucgguuuaaagacgauacgucuuucgaggacaucaauggcauucgccgaccaaagcacuuguacguaucgaugcccacugcccaaucaaccaugaaggcugaggaacucacaccugguagauuuaggacuaucguuugcgggcuguucccaacccagauacaggugcggaacauuaugagccccgucaugggagugaucggcuuuaguuucuuugugaaagauuggccugagaagauucgugaguucauggagaaagaauguccauuuaucaagccggaggucaaacccggcaccccugcccaggagguugaguuccugaagcgcaauagaguguauuuuaugacaaggcaagacguacucgauaaaaaccauguggcggacaucgauaaguuaauugacuacgcagccuccggggauccaacgucucccgacgauauagaaagcccuaaugcuccaugggucuucgccugcgcacccgaccgguguccgccuacuugcaucuacguggcuggaauggccgaacugggugcguuuuucuccauucuucaggacaugcgaaacacaaucauggccucaaagaccguuggcacugcagaggaaaaauugaagaaaaagaguagcuucuaucagucuuaccugcgcagaacacaauccauggggauacagcuagaucagaggauuauccuccuguauaugcuugaguggggaaaagagaugguggaccacuuucaucugggcgaugacauggaucccgaauugcggggucucgcucagucacugaucgaccaaaaggucaaggagauuagcaaucaggaaccauuaaaaaucuga

SEQ ID NO: 5786 - RNA, 1302 nt, Artificial Sequence
  derived and/or modified CDS sequence (opt3) from PUUV(Aijajarvi/Mg7/05)__GQ339476.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaagggcugggccgauaggauccgggaauuuauggagaaagaauguccuuucauuaagccagaggugaaaccggggacacccacccaagaagucgaguuucucaagaaaaauaagguuuauuucuuagaccgucagaacgugcuggauaagaaucauguagcggacaucgauaaacuuaucgacuacgcagccaguggagauccuacgucuccagacaacauugagagccccaaugcuccuuggguguuugccugcgcaccagaccgcugucccccgacuugcauauaugucgcugguauggccgaauugggcgcguucuucuccauccugcaggauaugagaaacacaauuauggccucaaagaccguggggacugcagaggaaaaacuaaagaaaaagaguagcuuuuaccaaucuuaccucaggcggacacaguccaugggaauccagcuggaccagcgaauaauucuucuguucauguuggaguggggcaaggaaaugguugaucacuuucaucucggugacgauauggacccugagcugcgcggguuagcucaagcccugaucgaucagaaagugaaggagaucucaaaucaggaaccccucaaaauuuga

SEQ ID NO: 5787 - RNA, 1302 nt, Artificial Sequence
  derived and/or modified CDS sequence (opt3) from PUUV(Bavaria 151/05)__EU439968.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuucucaagccagaaauuaaaccgggcacacccgcgcaggaggcagaguucuuaaagaaaaauaagguguacuuuaugcaacgccaggacguccuggauaagaaccauguugccgacaucgauaaacuuaucgacuaugcugccuccggggauccuaccucuccagacaauauugaaagccccaacgcaccuuggguguucgcuugcgccccagacagaugucccccgacgugcauauacguagcgggaauggccgaguugggugcauuuuucuccauccugcaggauaugaggaauacuauuauggcuucaaagacagugggcaccgccgaagagaaacuaaagaaaaagaguagcuucuaccaaucuuaucuccggcgaacucaguccauggggauccagcuggaccagcgcauaauucuucuguacauguuggaauggggaaaggagauggucgaucacuuucaucucggcgacgauauggacccugagcugagagguuuagcucaagcccugaucgaucagaaagugaaggaaaucucaaaccaggagccccucaaaauuuga

SEQ ID NO: 5788 - RNA, 1302 nt, Artificial Sequence
  derived and/or modified CDS sequence (opt3) from PUUV(Bavaria 159/05)__EU439972.1__N
augagcgaccugaccgauauccacgaggacauuacaagacaugaacagcaacucguggucgccaggcagaaacuuaaggaugcugagaaggcaguugaaauggaccccgaugacgugaacaaaaauacucugcaggcccggcagcaaacgguauccgcguuggaggauaaguuagcugacuacaaacgccgaauggccgaugcagugucucguaagaagauggacaccaaaccuacagauccaacuggcauagaaccggacgaucaccugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaucucuaugugucgaugcccacugcccagucaaccaugaaagcugaggagcugacaccuggucgauuuagaacuauuguaugcgggcuguucccaacccaaauccagguuaggaacauaaugagccccgugaugggagucauuggcuuuaguuucuuugugaaggauugggccgaacggauccgugaguucauggaaaaagaguguccuuuuauuaagccagaaaucaaaccgggcacacccgcgcaggaggcagaguuccucaagcgcaauaaaguguacuuuaugcagagacaagacgucuuagauaagaaccacguugccgacaucgauaagcugauugacuaugcugccuccggggauccuaccucuccagacaauauagaaagccccaacgcaccuuggguguucgcuugcgccccagacaggugucccccgacgugcaucuacguagcgggaauggccgagcuuggugcauuuuucuccauuuugcaggauaugcggaauacuaucauggcuucaaaaacagugggcaccgccgaagagaagcugaaaaagaaaaguagcuucuaccagucuuaucuacgacgcacucaauccauggggauacagcucgaccagagaauuauccugcuuuacaugcuggaauggggaaaggagauggucgaucauuuucacuugggcgacgauauggacccugagcucaggggucuggcucaggccuuaaucgaucaaaaggugaaagaaauuucaaaccaggagccccugaagaucuga

SEQ ID NO: 5789 - RNA, 1299 nt, Artificial Sequence
  derived and/or modified CDS sequence (opt3) from PUUV(Bavaria CG 33/04)__DQ016430.2__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuuauuaagccagaaaucaaaccgggcacacccgcgcaggaggcagaguuccucaagcgcaauaaaguguacuuuaugcaaagacaggacgucuuagauaagaaccauguugccgacaucgauaagcugauugacuaugcugccuccggggauccuaccucuccagacaauauagaaagccccaacgcaccuuggguguucgcuugcgccccagacaggugucccccgacgugcaucuacguagcgggaauggccgagcuuggugcauuuuccauuuugcaggauaugcggaauacuaucauggcuucaaaaacagugggcaccgccgaagagaagcugaaaaagaaaaguagcuucuaccaaucuuaucuacgacgcacucaguccauggggauacagcucgaccagagaauuauccugcuuuacaugcuggaauggggaaaggagauggucgaucacuuccauuugggcgacgauauggacccugagcucaggggucuggcucaagccuuaaucgaucagaaggugaaagaaauuucaaaccaggagccccugaagaucuga

SEQ ID NO: 5790 - RNA, 1302 nt, Artificial Sequence
  derived and/or modified CDS sequence (opt3) from PUUV(Bavaria CG 34/04)__AY954723.2__N
augagcgaccugaccgauauccaggaggacauuacaagacacgaacaacagcucguggucgccaggcagaaacuuaaggaugcuggcaaggcaguugagauggaccccgaugacgugaacaaaaauacucugcaggcccggcaacagacgguauccgcguuggaagauaaguuagcugacuacaaacgccgaauggccgaugcagugucucguaagaagauggacaccaaaccuacagauccaacugggauagagccggacgaucaucugaaggaaagaucaagucuaagguauggaaacguccucgacgugaaugccaucgacauugaggagcccagcggucagaccgcugauugguacacaaucggcguuuaugugauuggguucacccugccuaucauacuuaaagcacuguacauguuguccacucggggacgccagacagucaaggaaaacaaaggcaccagaaucagguuuaaggacgauacgucuuucgaggacauuaaugguauccggcgcccaaagcaccucuaugugucgaugcccacugcccaaucaaccaugaaagcugaagaacugacaccugggcgauuuagaacuauuguaugcggacuguucccaacccagauccagguuaggaacauaaugagccccgugaugggcgucauuggcuuuaguuucuuugugaaggauugggccgagcggauccgugaguucauggagaaagaauguccuuuuauuaagccagagaugaaaccggggacacccgcgcaggaagcagaguuccucaagcgcaauaaaguguacuuuaugcaaagacaggacgucuuagauaagaaccauguugccgacaucgauaagcugaucgacuaugcugccuccggagauccuaccucuccagacaauauugagagccccaacgcaccuuggguguucgcuugcgccccagacaggugucccccgacgugcauauacguagcggguauggccgaacuuggcgcauuuuucuccaucuugcaggauaugcggaauacuauuauggcuucaaaaacaguggggaccgccgaggaaaagcugaaaaagaaaaguagcuucuaccaaucuuaucuacgacgcacucaguccaugggaauccagcucgaccagagaauaauucugcuuuacaugcuggaguggggcaaggaaauggucgaucacuuucauuugggugacgauauggacccugagcucagggggcuggcucaagccuuaaucgaucagaaggugaaagagaucucaaaccaggaaccccugaagauuuga

SEQ ID NO: 5791 - RNA, 1302 nt, Artificial Sequence
  derived and/or modified CDS sequence (opt3) from PUUV(Bavaria CG 41/04)__DQ016432.2__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaacuuagcugacuacaagcgccgaauggccgaugcagugucucguaaaaagauggacaccaagccuacagauccaacuggcauagaaccggacgaucaucugaaagagagaucaagucuaagguaugggaauguccucgacgugaacgccaucgacauugaggaacccagcggacagaccgcugauugguacacaaucgguguuuaugugauuggcuucacccugccuaucauacuuaaggcacuguacauguuguccacucgggggcgccagacagucaaagagaauaagggaaccagaaucagguuuaaagacgauacgucuuucgaagacauuaacggcauccggcgcccaaagcaccucuaugugucgaugcccacugcccaaucaaccaugaaggcugaggagcugacaccuggucgauuuagaacuauuguaugcgggcuguucccaacccagauccagguuaggaauauaaugagccccgugaugggagucauuggcuuuaguuucuuugugaaagauugggccgaacggauccgugaguucauggaaaaggaguguccuuuuauuaaaccagaaaugaagccgggcacacccgcgcaggaggcagaguuccucaaacgcaacaagguguacuuuaugcaaagacaggacgucuuagauaaaaaucauguugccgacaucgauaagcugaucgacuaugcugccuccggggauccuaccucuccagacaacauugaaagccccaaugcaccuuggguguucgcuugcgccccagacaggugucccccgacgugcauauacguagcgggaauggccgagcuuggugcauuuuucuccaucuugcaggauaugcggaacacuauuauggcuucaaagacagugggcaccgccgaagagaaacugaagaaaaagaguagcuucuaccaaucuuaucuacgacgcacucaguccauggggauccagcucgaccagagaauaauucugcuuuacaugcuggaauggggaaaagagauggucgaucacuuucauuugggcgacgauauggacccugagcucaggggucuggcucaagccuuaaucgaucagaaggugaaggaaaucucaaaucaggagccccugaaaauuuga

SEQ ID NO: 5792 - RNA, 1302 nt, Artificial Sequence
  derived and/or modified CDS sequence (opt3) from PUUV(Bavaria CG 9/04)__AY954722.2__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuuauuaagccagaaaugaaaccgggcauccccgcgcaggaggcagaguuccucaagcgcaauaaaguguacuuuaugcaaagacaggacgucuuagauaagaaccauguugccgacaucgauaagcugauugacuaugcugccuccggggauccuacaucuccagacaauauagaaagccccaacgcaccuuggguguucgcuugcgccccagacaggugucccccgaccugcaucuacguagcgggaauggccgagcuuggugcauuuuucuccauuuugcaggauaugcggaauacgaucauggcuucaaaaacugugggcacagccgaagagaagcugaaaaagaaaaguagcuucuaccaaucuuaucuacgacgcacccaguccauggggauacagcucgaccagagaauuauccugcuuuacaugcuggaauggggaaaggagauggucgaucacuuucauuugggcgacgauauggacccugagcucaggggucuggcucaagccuuaaucgaucagaaggugaaagaaauuucaaaccaggagccccugaagaucuga

SEQ ID NO: 5793 - RNA, 1302 nt, Artificial Sequence
  derived and/or modified CDS sequence (opt3) from PUUV(Bergsjobo/Mg25/05)__GQ339483.1__N
augagcgaccuggccgauauccaggacgagauuaccagacacgaacaacagcucguggcugcaaggcagaaacuuaaagaugccgagcgggcggucgaaguugaccccgaugacgugaacaagaauacacugcaggcucgccaacagacuguauccgccuuggaggauaaauuagcagacuucaagcgacguauggccgaugcugugucuagaaagaagauggacacgaagccuaccgauccaacaggcauagaaccggacgaucaucugaaagagaggucaagucuacgguacgggaacguccucgacgugaaugcaaucgacauugaggaacccagcggacagacugccgauugguauaccaucgguguuuacgugauuggcuuuacacugccuaucauacuuaaggcucuguauauguuguccacccgcgggagacagacugucaaagagaacaagggaacaaggauccgguucaaagacgauaccucuuuugaagacauuaauggcauccgccgaccaaagcaccucuacgugucgaugcccacggcccaaucaacuaugaaggcggaggagcugaccccugguagauucaggacaauuguaugcgggcuguuuccaacucagauccagguucggaacauaaugagccccgugaugggagucauuggcuucuccuuuuucgugaaagauugggcagaacguauccgcgaguuuauggaaaaggaguguccuuucauuaaaccagaagugaagccgggcacccccgcccaggaggucgaguuucucaaaaagaauaaaaucuauuucaugcaaagacaggacguuuuagauaagaaccauguggcugacaucgauaagcugauugacuacgccgcaaguggggauccuacaucuccagacaauauagaaagccccaacgcuccuuggguauuugccugcgcgccagacaggugucccccgaccugcaucuauguggccggaauggcagagcuuggugcuuucuucuccauuuugcaggauaugcggaauacgaucauggccucaaaaacugucggcacagcugaagagaagcugaaaaagaaaaguagcuuuuaccaaucuuaccuacgacgcacccaguccauggggauacagcucgaccagagaauuauccugcuuuauaugcuggaauggggaaaggagaugguggaucacuuccauuugggcgacgauauggacccugagcucaggggucuggcccaagcauuaaucgaucagaagguuaaagaaauuucaaaccaggagccccugaagaucuga

SEQ ID NO: 5794 - RNA, 1302 nt, Artificial Sequence
  derived and/or modified CDS sequence (opt3) from PUUV(CG14444)__AJ277075.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccgcgcaagaagcagaguuucucaagcguaauaaaaucuauuucaugcagcgccaggaggucuuagauaagaaccauguugccgacaucgauaagcugauugacuacgcugccaguggggauccuaccucuccagacaauauagaagcacccaacgcuccuuggguguuugccugcgcgccagacagaugucccccgacgugcaucuauguagccggaauggcagagcuuggugcuuucuucagcauuuugcaagauaugaggaauacuaucauggccuccaaaacagugggcaccgcugaagagaagcugaaaaagaaaucaaguuuuuaccagagcuaccuacggcgaacucagucuauggggauacagcucgaccaacgcauuauccugcuuuauaugcuggaauggggaaaggagauggucgaucacuuccauuugggcgacgauauggacccugagcucagaggucuggcccaggcauuaaucgaucagaaggugaaagaaauuuccaaccaggagccccugaagaucuga

SEQ ID NO: 5795 - RNA, 1302 nt, Artificial Sequence
  derived and/or modified CDS sequence (opt3) from PUUV(CG14445)__AJ277076.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccgcgcaagaagcagaguuucucaagcguaauaucaucuauuucaugcagcgccaggaggucuuagauaaaaaccauguugccgacauugauaagcugauagacuacgcugccaguggggauccuaccucuccagacaauaucgaagcacccaacgcuccuuggguguuugccugcgcgccagacagaugucccccgacgugcauuuauguagccggaauggcagagcuuggugcuuucuucagcaucuugcaagauaugaggaauacuauaauggccuccaagacagugggcaccgcugaagagaaacugaagaaaaagucaaguuuuuaccagagcuaccuacggcgaacucagucuauggggauucagcucgaccaacgcaucauccugcuuuauaugcuggaauggggaaaagagauggucgaucacuuccauuugggcgacgauauggacccugagcucagaggucuggcccaggcauuaauugaucagaaggugaaggaaaucuccaaccaggagccccugaaaauuuga

SEQ ID NO: 5796 - RNA, 1302 nt, Artificial Sequence
  derived and/or modified CDS sequence (opt3) from PUUV(CG1820/POR)__KT885052.1__N
augagcgaccugaccgauauccaggaggaaauuacaagacacgagcaacagcucguggucgccaggcagaaacuuaaagacgcugaacgggcaguugagguggaucccgacgauguaaacaaguccacucugcaggcccgccaacagacggugucugcguuggaagacaaauuagcugauuacaagcgacguauggccgacgcagucucaagaaagaagauggauaccaagccuacagacccaacuggcauagagccggaugaccaucugaaagagaggaguagccuacgguaugggaaugugcucgauguuaacgccaucgacauugaagaacccuccggacagaccgcugacugguacacaaucgguguguaugucauuggcuucaccaucccuauaauccugaaggcacuuuacaugcugucuacucgcgggagacagacagugaaagaaaauaagggaaccaggauucgguuuaaagaugacacgucguucgaggauaucaacggcauucgccgaccaaagcacuuguauguaucaaugcccacugcccaaagcaccaugaaggcugaggaacucacaccugguagauuuaggacuaucguuugcgggcuguucccaacccagauacaggugcggaauauuaugagucccgucaugggagugaucggcuuuuccuucuuugugaaagacuggccugagaagauucgugaguucauggagaaagaauguccauuuaucaagccggaggucaaacccggcaccccugcccaggagguugaguuccugaagcgcaacagaguguacuuuaugacaaggcaagauguacucgacaaaaaucauguggcggauaucgacaaguuaauugauuaugcagccucuggggacccaacgagccccgaugacauagaauccccuaacgcuccaugggucuucgccugcgcacccgaccgguguccgccuacuugcaucuacguggcuggaauggccgaacugggugcguuuuucucaauucuucaggauaugcgaaauacaaucauggccaguaagaccguuggcacugcagaggaaaaauugaagaaaaagagcucuuucuaccaguccuaucugcgcagaacacaaucaauggggauacagcuagaccagaggauuauccuccuguacaugcuugaguggggaaaagagaugguggaucacuuucaucugggcgacgauauggaccccgaauugcggggucucgcucagagccugaucgaucaaaaggucaaggagauuaguaaccaggaaccauuaaaaaucuga

SEQ ID NO: 5797 - RNA, 1302 nt, Artificial Sequence
  derived and/or modified CDS sequence (opt3) from PUUV(Couvin/59Cg/97)__AJ277034.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccgcgcaagaagcagaguuucucaagcguaauaaaaucuauuucaugcagcgccaggaugucuuagacaagaaccauguugccgauaucgacaagcugauugauuacgcugccaguggggacccuaccucuccagacaauauagaggcacccaacgcuccuuggguguuugccugcgcgccagauagaugucccccgacgugcaucuauguagccggaauggcagaacuuggugcuuucuucagcauuuugcaagacaugaggaauacuaucauggccuccaaaacagugggcaccgcugaggaaaagcugaaaaagaaaucaaguuuuuaccagagcuaccuacggcgaacucagucuauggggauacagcucgaucaacgcauuauccugcuuuauaugcuggaguggggaaaggaaauggucgaccacuuccauuugggcgaugacauggauccugagcucagaggucuggcccaggcauuaaucgaccagaaggugaaagagauuuccaaccaggaaccccugaagaucuga

SEQ ID NO: 5798 - RNA, 1302 nt, Artificial Sequence
  derived and/or modified CDS sequence (opt3) from PUUV(Evo/12Cg/93)__Z30702.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucaccaucccuauaauccugaaggcacuuuacaugcuguccacucgcgggagacagacagugaaagagaacaagggaaccaggauucgguuuaaagacgauacgucuuucgaagacaucaauggcauucgccgaccaaagcacuuguauguaucgaugcccacugcccaaucaaccaugaaggcugaggagcucacaccugguagauuuaggacuaucguuugcgggcuguucccaacccagauacaggugcggaacauuaugagccccgucaugggagugaucggcuuuaguuucuuugugaaagauuggccugaacguauucgcgaguucauggaaaaggaguguccauuuaucaaaccggaaaucaagcccggcaccccugcccaggagauggagaugcugaaaagaaauaagauuuacuucaugcaaaggcaggacguccucgauaaaaaccauguugcggacauagauaaguuaaucgacuaugcagccuccggggauccaacaucucccgacaauauugacagcccuaacgcuccauggguguuugccugcgcacccgaucgguguccgccuacgugcaucuacguagcuggaauggccgaacugggugcguucuuuuccauacuucaggacaugcgaaauacuauuauggccucaaagacagugggcaccgcagaggaaaaauugcgcaagaaaaguagcuucuaccaaucuuaucugagaaggacucaguccauggggauccagcuagaucagcggaucauucuccuguucaugcuugaguggggaaaggaaauggucgaccacuuucaucugggcgaugacauggaucccgaguugcgcggucucgcucaagcccugaucgaccagaaagugaaggagauuucaaaccaggaaccauuaaagauauga

SEQ ID NO: 5799 - RNA, 1302 nt, Artificial Sequence
  derived and/or modified CDS sequence (opt3) from PUUV(Evo/14Cg/93)__Z30704.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcuaacuacaagcgacguauggccgacgcagucucuagaaagaagauggauaccaagccuacagacccaacuggcauagaaccggaugaccaucugaaagagaggucaagucuacgguaugggaaugugcucgauguuaacgccaucgacauugaggaacccagcggacagaccgcugacugguacacaaucgguguguaugucauuggcuucaccaucccuauaauccugaaggcacuuuacaugcuguccacucgcgggagacagacagugaaagagaauaagggaaccaggauucgguuuaaagaugacacgucuuucgaagauaucaacggcauucgccgaccaaagcacuuguauguaucgaugcccacugcccaaucaaccaugaaggcugaggagcucacaccugguagauuuaggacuaucguuugcgggcuguucccaacccagauacaggugcggaauauuaugagccccgucaugggagugaucggcuuuaguuucuuugugaaagacuggccugaacguauucgcgaguucauggaaaaggaguguccauuuaucaaaccggaaaucaagcccggcaccccugcccaggagauggagaugcugaaaagaaacaagauuuacuucaugcaaaggcaggauguccucgacaaaaaucauguugcggauauagacaaguuaaucgauuaugcagccuccgggggaccaacaucucccgacaacauugauagcccuaaugcuccauggguguuugccugcgcacccgaccgguguccgccuacgugcaucuacguagcugguauggccgaacugggcgcguucuuuuccauacuucaggacaugcgaaacacuauuauggccucaaagacaguggggaccgcagaggaaaaauugaagaaaaagaguagcuucuaccaaucuuaucugcgcagaacucaguccaugggaauccagcuagaucagaggaucauucuccuguucaugcuugaguggggcaaagaaauggucgaccacuuucaucugggugaugacauggaucccgaguugcgggggcucgcucaagcccugaucgaccagaaggugaaggagauuucaaaucaggaaccauuaaaaauauga

SEQ ID NO: 5800 - RNA, 1302 nt, Artificial Sequence
  derived and/or modified CDS sequence (opt3) from PUUV(Evo/15Cg/93)__Z30705.1__N
augagcgaccugaccgauauccaggaggacauuacaagacacgaacaacagcucguggucgccaggcagggccuuaaggaugcugagcgggcaguugaaguggaccccgaugacguaaacaaaaaugcccugcaggcgcgccaacagacuguguccgcuuuggaggauaaguuagccgacuacaaacgacguauggcagaugccgucucuagaaagaaaauggacacgaagccuaccgauccaacagggauagaaccggacgaucaucugaaggagaggucaagucuacgguauggaaacguguucgacguuaaugcuaucgacauugaggaacccagcggucagacugcagauugguacaccaucggcguguaugucauuggguuuacaaucccuauaauccucaaagcccuguacaugcuuuccacccgcggaagacagacugugaaggagaacaaaggcacaaggauucgguucaaggacgauaccucuuuugaagacaucaaugguauucgccgaccaaaacaccuguauguaucgaugcccacggcucaaucaacuaugaaggccgaggaguugaccccugggagauucaggacaaucguuugcggacucuuuccaacucagauacaggugcggaacauuaugagccccgucaugggcgugaucggcuucuccuuuuucgugaaggauuggccugaacguauucgcgaguuuauggaaaaagaguguccauucaucaagccggaaaucaaacccgggaccccugcgcaggagauggagaugcugaagagaaauaaaauuuacuuuaugcaaaggcaggacguccuggauaagaaccauguugcagacauagauaaacucaucgacuaugccgcuaguggagauccaacaucucccgacaauauugacagcccuaacgccccauggguguucgcaugcgcucccgaucgguguccgccuaccugcaucuacguagccgguauggcggaauuaggcgccuuuuucuccauacugcaggacaugcgaaauacgauuauggcaucaaagacuguggggacagcugaggaaaaacuuaagaagaaaaguagcuucuaccaaucuuauuugcgcagaacccaguccaugggaauccagcuggaucagaggaucauucuacucuuuaugcuggaguggggcaaggaaauggucgaccacuuccaucuuggugaugacauggaucccgagcugcggggguuggcccaagcucucaucgaccagaaagugaaggagauuucaaaccaggaaccacugaagauauga

SEQ ID NO: 5801 - RNA, 1302 nt, Artificial Sequence
  derived and/or modified CDS sequence (opt3) from PUUV(Faboviken/Mg26/05)__GQ339484.1__N
augagcgaccuggccgauauccaggacgagauuaccagacacgaacaacagcucguggcugcaaggcagaaacuuaaagaugccgagcgggcggucgaaauggaccccgaugacguuaacaagaauacacugcaggcucgccaacagacuguguccgccuuggaggauaaauuagcagacuucaagcgacguauggccgaugcuguaucuagaaagaagauggacacgaagccuaccgauccaacaggcauagaaccggacgaucaucugaaagagaucucaagucuaagguacgggaacgugcucgacgucaaugcaauugacaucgaggaacccagcggacagacugccgauugguauaccauugguguguacguuaucggcuuuacacugccuauaauccuuaaggcucuguauauguuguccacccgggggcgccagacugugaaagagaacaagggaacaagaauuagguucaaagacgauaccucuuuugaagacaucaauggcauucggcgcccaaagcaccucuacgucucgaugcccacggcccaaucaacuaugaaggcggaggagcugaccccuggucgauucagaacaaucgugugcgggcuguuuccaacucagauacagguaaggaacauuaugagccccguuaugggagugaucggcuucuccuuuuucgucaaagauugggcagaacggauucgugaguuuauggaaaaggaguguccuuucaucaaaccagaagugaagccgggcacccccgcccaggagguggaguuucucaaaaagaauaaaaucuauuucaugcaacgccaggacgucuuagauaagaaccauguugcugacauugauaagcugauagacuacgccgcaaguggggauccuacaucuccagacaauaucgaaagccccaacgcuccuuggguguuugccugcgcgccagacagaugucccccgaccugcauuuauguagccggaauggcagagcuuggugcuuucuucuccaucuugcaggauaugaggaauacgauaauggccucaaaaacugugggcacagcugaagagaagcugaaaaagaaaaguagcuuuuaccaaucuuaccuacggcgaacccaguccauggggauucagcucgaccagcgcaucauccugcuuuauaugcuggaauggggaaaggagauggucgaucacuuccauuugggcgacgauauggacccugagcucagaggucuggcccaagcauuaauugaucagaaggugaaagaaaucucaaaccaggagccccugaagauuuga

SEQ ID NO: 5802 - RNA, 1302 nt, Artificial Sequence
  derived and/or modified CDS sequence (opt3) from PUUV(Fyn)__AJ238791.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauugggccgaacggauccgugaguuuauggaaaaagaguguccuuucauuaagccagaacucaaaccgggcacaaaugcgcaggaggcagaguuuuuaaagaaaaaccgcguguauuuccugaauagacaagacguccuugauaagaaccauguugccgacaucgauaaguugaucgacuacgcugccaguggggaucccaccucuccugacaauauugaagcaccaaacgcucccuggguguuuagcugcgccccugacagguguccacccacgugcauauauguagcgggaauggccgagcugggugcauucuucuccauccuacaggauaugcggaauacuauuauggcuucaaaaacagugggcaccgccgaagagaagcucaaaaagaaaaguagcuuuuaccagucuuaccugcgacgcacucaauccauggggauccagcuugaccagagaauaauucuguuguauaugcucgaauggggaaaggagauggucgaucacuuccaucugggcgacgauauggacccggaguuaaggggucuggcucaggcccucaucgaucaaaaggugaaagaaaucucaaaccaggagccucuuaagauuuga

SEQ ID NO: 5803 - RNA, 1302 nt, Artificial Sequence
  derived and/or modified CDS sequence (opt3) from PUUV(Fyn131)__AJ278093.1__N
augagcgaccugaccgauauccaggaggacauuacaagacacgaacaacagcucguggucgccaggcagaaacuuaaagaugcugagaaggcaguugaaauggaccccgaugacgugaacaaaaauacucuggaggcccggcagcaaacgguauccgcguuggaagauaaguuagcugacuucaaacgccgaaugaccgaugccgugucucguaagaagauggacacaaaaccuacugauccaaccggcauagagccggacgaucaucugaaggagagaucaagucuaagguacgggaacguccucgacgugaaugcaaucgacauugaggaacccagcggacagacagccgauugguauaccaucgguguuuacgugauuggcuuuacucugccuaucauacuuaaagcucuguauauguuguccacacgggggcgccagaccgucaaggaaaacaaaggaacgagaaucagguucaaggacgauacuucuuuugaggacauuaauggcauccggcgcccaaagcaccucuacgugucgaugcccaccgcaccuucaacaaugaaagccgaggaacugacuccaggucgauucagaaccauuguaugcgggcuguuucccacacagauccaaguuaggaacauaaugagcccugugaugggagucauuggcaguuccuucuuugugaaggauugggcugaccggauccgugaguucauggaaaaagaguguccauuugugaagccggaacucaaacccggcaccaaugcccaggaggcggaguucuuaaagaaaaaccgcgucuauuuuaugaauagacaggauguucuggacaagaaccauguggcagauauugacaaacuuaucgauuacgccgcuucuggggacccuacgugcccagacaauaucgaagcccccaacgcaccuuggggauucgcuugugccccacacaggugucccccgacuugcauuuauguagcggguauggccgaguugggcgcauuuuucagcauacugcaggauaugcggaauacaaucauggcuuccaagaccguggggacugccgaagagaagcuaaagaagaaaucaaguuucuaccaaagcuaccuccgacgcacacagucuaugggcauucagcuggaccaaagaaucauacuucuguauauguuggaauggggaagggagauggucgaucauuuucaccucggugacgauauggacccugagcugcggggguuagcucaggcccugauuaaccagaaggugaaggaaaucuccaaucaggagccccucaaaaucuga

SEQ ID NO: 5804 - RNA, 1302 nt, Artificial Sequence
  derived and/or modified CDS sequence (opt3) from PUUV(Fyn47)__AJ278092.1__N
augagcgaccugaccgauauccaggaggacauuacaagacacgaacaacagcucguggucgccaggcagaaacuuaaagaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugccccuucaaccaugaaagcugaggagcugacaccaggucgauucagaacuauuguaugcgggcuguuucccacccaaauccagguuaggaagauaaugagcccugugaugggagucauuggcuucuccuuuuucgugaaagauuggguggaacggauccgugaguuuauggaaaaggaguguccauucgucaaaccggaacucaagcccggcacaaacgcccaggaggcggaguuuuuaaagaagaaucgcguuuauuucaugaacagacaggacgugcuggauaagaaucauguagcagacauugauaaacuuaucgacuacgccgcuaguggggauccuaccucuccagacaacaucgaagcccccaaugcaccuuggguguuugcuugcgccccacacaggugucccccgacgugcauuuaugucgcgggaauggccgaguugggugcauucuucagcauacugcaagacaugcggaacgcuaucauggccuccaagacugugggcacagcugaagagaaacuaaagaaaaagucaaguuuuuaccagagcuaccuccgacgcacccagucuguugggauucaacuggaucagagaaucauacuucuguauauguuggaauggggaagggagaugguggaccauuuccaccucggcgaugacauggauccugagcugcgggguuuagcccaggcacugauugaccagaaggucaaagaaaucuccaaucaagagccccucaagaucuga

SEQ ID NO: 5805 - RNA, 1302 nt, Artificial Sequence
  derived and/or modified CDS sequence (opt3) from PUUV(Gomselga)__AJ238790.1__N
augagcgaccugaccgauauccaggaggacauuacaagacacgaacaacagcucguggucgccaggcagaaacuuaaggaugcugagcgggcaguugaaguggaccccgaugacguaaacaagaauacucugcaggcccgccaacagacgguguccgcguuggaggauaaauuagcugacuacaagcgaaaaauggccgaugcagucucucguaagaagauggacaccaaaccuacagauccaacuggcauagaaccggacgaucaucugaaggagagaucaagucuaagguaugggaacgugcucgacguuaaugccaucgacauugaggaucccagcggacagaccgcugacugguacacaaucgguguguaugucauuggcuucacccugccuaucauacuuaaagcacuguacauguuguccacucgggggcgccagacagugaaggaaaacaaaggaaccagaaucagguuuaaggaugacacgucuuucgaggaaauuaauggcauccggcgcccaaagcaccucuauguaucgaugcccacugcccaaucaaccaugaaagcugaggagcugacaccuggucgauuuagaacuauuguuugcgggcuguucccaacccagauccaggugaggaacauagucagccccgugaugggagugauuggcuuuaguuucuuugucaaggauuggucccagcggaucacagaguucauggaaaaagaauguccuuuuauuaagccagagguuaaaccgggcacccccgcccaagaaaucgagauguucaagcguaauaaaaucuacuuuaugcagcgccaggacgugcucgauaagaaccauguagcggacauugauaagucuauagacuaugcagccagcgaggauccuacguccccagacaauaucgacucacccaacgcuccuuggguguucgccugcgcaccagauagaugucccccgacuugcauuuacgucgcugggauggccgaauuaggagcguuuuucaguauccugcaagacaugaggaauacaauaauggccagcaaaaccguggguacugcagaggaaaaacuuaagaagaaaucuuccuucuaccagucauauuugcggcgaacacagagcaugggcauucagcuggaucaacgcaucauccuacucuuuaugcuggagugggggaaggaaaugguugaccacuuccaucuuggagaugacauggauccugagcugagaggcuuggcucaggcccucauugaccagaaggugaaagagaucaguaaccaggaaccccugaagauuuga

SEQ ID NO: 5806 - RNA, 1302 nt, Artificial Sequence
  derived and/or modified CDS sequence (opt3) from PUUV(Gyttjea/Mg19/05)__GQ339480.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucgccuuuuucgugaagggcugggcggauaggauccgggaauuuauggagaaagaauguccuuucauuaagccagaggugaaaccggggacacccacccaagaaaucgaguuucucaagaaaaauaaggucuauuucuuagaccgucagacgguucuggauaagaaccauguggcagacaucgauaaacuuauugacuacgccgcuaguggagauccuacuuccccagacaauauagagucucccaacgccccuuggguauuugcaugcgcuccagaccgcugucccccgacaugcaucuauguggccgguauggcggaauugggcgccuucuucagcauucugcaggauaugagaaauaccaucauggcauccaagacugucgggacagcugaggaaaaacuaaagaaaaagucaaguuuuuaccaaagcuaccucaggcggacccagucuaugggaauacagcuggaccagcgaauuauccuucuguucauguuggaguggggcaaggaaaugguggaucacuuucaucucggugacgauauggacccugagcugcgcggguuagcccaagcucugaucgaucagaaaguuaaggagauuuccaaccaggaaccccucaaaaucuga

SEQ ID NO: 5807 - RNA, 1302 nt, Artificial Sequence
  derived and/or modified CDS sequence (opt3) from PUUV(Karhumaki)__AJ238788.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgaaaaauggccgaugcagucucucguaagaagauggacaccaaaccuacagauccaacuggcaugaagccggacgugcaucugaaagaaagaucaagucuagaguaugggaacguucucgaugugaaugccauagacaucgaggaacccagcggacagaccgcugacugguacacaauuggugucuaugugaucggcuucacccugccuauuauccuuaaggcacuguacauguuguccacuagggggcggcagacaguaaaagagaacaagggaacccgcauaagauuuaaggaugacacgucuuucgaagauaucaauggcauuaggcggccaaaacaccucuauguuucgaugcccacugcccaaucaaccaugaaggcugaggagcugacaccuggucgcuuucgaacuaucgugugcgggcuguucccaacccagauucaggucagaaacaucaugagccccgugaugggagugauaggcuuuaguuucuuugucaaagacugguccgaaaggauucgggaguucauggaaaaggaguguccuuuuaucaaaccagaaguuaagccgggcacacccgcccaggagauugagaugcuccgucgcaauaaaaucuacuucaugcaaagacaggauguguuagacaagaaccauguagcggauaucgacaagcugauugaucuugcagccucuggggacccuaccagcccagauaauauagacucccccaacgcuccuuggguguuugccugcgcaccagucaggugucccccgacgugcaucuauguggcuggaauggccgaauugggugcguucuuuucaauucugcaggacaugcggaauacuaucauggccaguaaaacaguuggcaccgcagaggaaaagcuaaagaagaaaagcucuuucuaccaauccuaccuccgacgcacucagucaauggggauacagcuggaucagagaauuauccuucuguucauguuggaguggggaaaggaaaugguggaccacuuucaucucggcgaugacauggauccugagcugagggguuuagcucaagcccugaucgaccagaaggucaaagagauuagcaaccaggaaccccucaagaucuga

SEQ ID NO: 5808 - RNA, 1302 nt, Artificial Sequence
  derived and/or modified CDS sequence (opt3) from PUUV(Kolodozero)__AJ238789.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcugaucccaacccagauacaggugcggaacauuaugagccccgucaugggagugaucggcuucuccuuuuucgugaaagauuggagugaacguauucgcgaguuuauggaaaaggaguguccuuucaucaaaccagaagucaagccgggcacaucugcccaggagaucgagaugcucaaaagaaauaagauuuacuuuaugcaaaggcaggacguuuuagauaaaaaccauguggcggacauagauaagcugaucgacuaugcagccagcggggaucccaccuccccugacaauauugacucaccaaacgcucccuggguauucgccugcgcaccugaucgguguccacccacgugcaucuacguggcuggaauggccgaacuuggugcguuuuucaguauauugcaggacaugcgaaauacuauuauggccagcaagacagucggcaccgcagaggaaaaacugaagaaaaagucuuccuuuuaccaaucauaucuacgcagaacucagagcauggggaucccgcucgaucagaggaucauucugcuuuucaugcuggaguggggacaggaaaugguggaccacuuccauuugggcgaugacauggauccugagcuccggggucuggcucaagccuuaaucgaccagaaaguuaaggagauuaguaaccaggaaccccugaagauauga

SEQ ID NO: 5809 - RNA, 1302 nt, Artificial Sequence
  derived and/or modified CDS sequence (opt3) from PUUV(Kuhmo/X11)__GU808825.1__N
augagcgaccugaccgauauccaggaggacauuacaagacacgaacaacagcucguggucgccaggcagaaacuuaaagaugcugagcgggcaguuggcguggaccccgaugacguaaacaagaauacucugcaggcccgccaacagacgguguccgcguuggaagauaaauuagcugacuacaagcgacguauggccgaugcagucucuagaaagaagauggacaccaagccuacagauccaacugggauagagccggacgaucaucugaaagaaaggucaagucuacgguauggaaacgugcucgacguuaaugccaucgacauugaggagcccagcggucagaccgcugauugguacacaaucggcguguaugucauuggguucacccugccuaucauacuuaaggcacuguacauguuguccacucgcggaagacagacagugaaagaaaacaagggcaccaggauccgguuuaaagacgauacgucuuucgaggacauuaaugguauccgccgaccaaagcaccucuauguaucgaugcccacugcccaaucaaccaugaaggcugaagaacugacaccugggagauuuaggacuauuguuugcggacuguucccaacccagauccaggugcggaacauaaugagccccgucaugggcgugauuggcuuuaguuucuuugugaaagauugguccgagcguauccgcgaguucauggagaaggaauguccuuuuauuaaaccagaggucaagccggggacacccgcccaggaaaucgagaugcucaaaagaaauaggaucuacuucaugcaacggcaggacguuuuagauaagaaccauguggcggacauugauaaacugauagacuaugcagccucuggagauccuaccagcccagacaauaucgacucccccaacgcuccuuggguauuugccugcgcaccagaucgaugucccccgacgugcauuuacguggcugguauggccgagcuuggcgcguucuuuucaaucuugcaggacaugcgcaauacuauaauggccaguaagacagucgggaccagcgaagagaagcugaaaaagaaaucuuccuucuaccaaucauaucuaagaaggacucagagcaugggcauucagcucgaucagcggaucauccugcuuuucaugcuggaauggggaaaggagaugguggaccacuuucauuugggugaugacauggauccugaacuccgcgggcuggcacaggcuuuaauugaccaaaaaguuaaggagaucaguaaccaggagccccugaagauuuga

SEQ ID NO: 5810 - RNA, 1302 nt, Artificial Sequence
  derived and/or modified CDS sequence (opt3) from PUUV(Kuhmo/X5)__GU808824.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauugguccgaacguauccgcgaguucauggaaaaggaguguccuuuuauuaaaccagaagucaagccgggcacacccgcccaggagaucgagaugcucaaaagaaauaggaucuacuucaugcaacggcaggacguuuuagauaagaaccauguggcggacauugauaaacugauagacuaugcagccucuggggauccuaccagcccagacaauaucgacucccccaacgcuccuuggguauuugccugcgcaccagaucgaugucccccgacgugcauuuacguggcuggaauggccgaacuuggugcguucuuuucaaucuugcaggacaugcgcaauacuauaauggccaguaagacagucggcaccgcagaggaaaagcugaaaaagaaaagcucuuucuaccaauccuaucuaagaaggacucagucaauggggauucagcucgaucagcggaucauccugcuuuucaugcuggaguggggaaaggaaaugguggaccacuuucauuugggcgaugacauggauccugagcuccgcggucuggcucaagccuuaauugaccagaaaguuaaggagaucagcaaccaggaaccccugaagauuuga

SEQ ID NO: 5811 - RNA, 1302 nt, Artificial Sequence
  derived and/or modified CDS sequence (opt3) from PUUV(Ljustrask/Mg20/05)__GQ339481.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucgccuuuuucgugaagggcugggcggauaggauccgggaauuuauggagaaagaauguccuuucauuaagccagaggugaaaccggggacacccacccaagaaaucgaguuucucaagaaaaauaaggucuauuucuuagaccgucagaacguucuggauaagaaucauguggcagacaucgauaaacuuauugacuacgccgcuaguggagauccuacguccccagacaacauagagucucccaaugccccuuggguauuugcaugcgcuccagaccgcugucccccgacuugcaucuauguggccgguauggcggaauugggcgccuucuucagcauucugcaggauaugagaaacacaaucauggcauccaagaccgucgggacugcugaggaaaaacuaaagaaaaagucaaguuuuuaccaaagcuaccucaggcggacacagucuaugggaauacagcuggaccagcgaauuauccuucuguucauguuggaguggggcaaggaaaugguggaucacuuucaucucggugacgauauggacccugagcugcgcggguuagcccaagcucugaucgaucagaaaguuaaggagauuuccaaucaggaaccccucaaaaucuga

SEQ ID NO: 5812 - RNA, 1302 nt, Artificial Sequence
  derived and/or modified CDS sequence (opt3) from PUUV(Mangelbo/Mg1/05)__GQ339485.1__N
augagcgaccugaccgauauccaggacgagauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuucaagcgacguauggcagaugccguaucuagaaagaagauggacaccaagccuacagauccaacuggcauagaaccggacgaucaucugaaagagaggucaagucuacgguacggggacgugcucgacgucaacgcuaucgauauugaggaacccagcggacagaccgcagacugguauacaaucgguguguacguuauuggcuuuacccugccuaucauacuuaaggcccuguauauguuguccacucgcgggagacagacagugaaagagaauaagggaaccaggauccgguucaaagaugacacgucuuuugaagauauuaacggcauccgccgaccaaagcaccucuacgucucgaugcccacugcucaaucaaccaugaaggccgaggagcugacaccugguagauucaggacuauugugugcgggcuguuuccaacccagauccagguacggaauauaaugagccccguuaugggagugauuggcuucuccuuuuucgucaaagacugggcggaacguauccgcgaguuuauggauaaggaauguccuuucauuaaaccagaggugaagccgggcacacccgcacaggaaaucgaguuucucaaaaagaacaaaaucuauuucaugcaaagacaggacguguuagauaagaaucaugucgccgacauugauaagcugauagacuacgcugccaguggggacccuaccucuccagauaacaucgagagccccaaugcaccuuggguuuuugcuugcgccccagacaggugucccccgacgugcauuuauguggcgggaauggccgaacuuggugcauucuucuccaucuugcaggauaugcggaacacuauaauggcuucaaaaacaguaggcaccgccgaggaaaagcugaaaaagaaaaguagcuuuuaccaaucuuaccuacgacgcacucaguccauggggauucagcucgaccagagaaucauccugcuuuauaugcuggaguggggaaaggaaaugguggaucacuuccauuugggcgacgauauggacccugagcucaggggucugacacaggcuuuaauugaucaaaaggucaaagagaucucaaaucccgaaccacugaagauuuga

SEQ ID NO: 5813 - RNA, 1302 nt, Artificial Sequence
  derived and/or modified CDS sequence (opt3) from PUUV(Momignies/55Cg/96)__AJ277033.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggucgaagcaccucuacgugucaaugccaacugcccagagcaccaugaaagcugaggagcugacacccggucgcuuccgaacuauuguaugcgggcuguuuccuacccagauccagguuagaaacauaaugaguccagugaugggagucauuggcuucuccuuuuucgugaaggauugggccgacaggauccgggaauuuauggagaaagaaugucccuucauuaagccugaggugaaaccaggcacaccggcgcaagaagcagaguuucucaagcguaauaaaaucuauuucaugcagcgccaggaugucuuagacaagaaccauguugccgauaucgacaagcugauugauuacgcugccucuggggaccccaccagcccugacaauauagaggcaccaaacgcucccuggguguuugccugcgcgccugauagauguccacccacgugcaucuauguagccggaauggcagaacuuggugcuuucuucuccauuuugcaagacaugaggaauacuaucauggccucaaaaacagugggcaccgcugaggaaaagcugaaaaagaaaaguagcuuuuaccagucuuaccuacggcgaacucaguccauggggauacagcucgaucaacgcauuauccugcuuuauaugcuggaguggggaaaggaaauggucgaccacuuccauuugucagaugacauggauccggagcucagaggccuggcccaggcauuaaucgaccagaaggugaaagagauuagcaaccaggaaccucugaagaucuga

SEQ ID NO: 5814 - RNA, 1302 nt, Artificial Sequence
  derived and/or modified CDS sequence (opt3) from PUUV(Montbliart/23Cg/96)__AJ277031.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccgcgcaagaagcagaguuucuccgucgcaauaagaucuauuucaugcagagacaggaggucuuagauaaaaaccauguugccgacaucgauaagcugauugacuacgcugccaguggggauccuaccucuccagacaauauagaagcacccaacgcuccuuggguguuugccugcgcgccagacaggugucccccgacgugcaucuauauugccggaauggcagagcuuggugcuuucuucagcaucuugcaagauaugcggaauacuauaauggccuccaagacaguaggcaccgcugaagagaaacugaagaaaaagucaaguuuuuaccagagcuaccuacgacgcacucagucuauggggauucagcucgaccaaagaaucauccugcuuuauaugcuggaauggggaaaagagaugguggaucacuuccauuugggcgacgauauggacccugagcucaggggucuggcccaggcauuaauugaucagaaggucaaggaaaucuccaaccaggagccccugaaaauuuga

SEQ ID NO: 5815 - RNA, 1302 nt, Artificial Sequence
  derived and/or modified CDS sequence (opt3) from PUUV(MuEb10Karlstadt/10)__JN696373.1__N
augagcgaccugaccgauauccaggaggacauuacaagacacgaacaacagcucguggucgccaggcagaaguuaaaagaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuuauuaagccagaaaucaaaccgggcacacccgugcaggaggcggaguuccucaagcgcaauaaagucuacuuuaugcaaagacaggaaguuuuagacaagaaccauguggcagauaucgacaagcugauugauuaugccgcuuccggggacccuaccucuccagauaauauagagagccccaacgccccuuggguauucgcaugcgcuccagacaggugucccccgacgugcaucuacguggccggaauggcggaacuuggugccuuuuucuccauuuugcaggacaugcggaauacuaucauggcaucaaaaacagucggcaccgcugaggaaaagcugaaaaagaaaaguagcuucuaccaaucuuaucuacgacgcacucaguccauggggauacagcucgaucagagaauuauccugcuuuacaugcuggaguggggaaaggagaugguggaccacuuucauuugggcgaugacauggauccugaacucaggggucuggcccaagcucuuaucgaccagaagguuaaagagauuucaaaccaggaaccccugaagaucuga

SEQ ID NO: 5816 - RNA, 1302 nt, Artificial Sequence
  derived and/or modified CDS sequence (opt3) from PUUV(MuEb12Lackenberg/10)__JN696374.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauugggccgaacggauccgugaguucauggaaaaagaguguccuuuuauuaagccagaaaugaaaccgggcacacccgcgcaggaggcagaguuccucaagcgcaauaaaguguacuuuaugcaaagacaggacgucuuagauaagaaccauguugccgacaucgauaagcugaucgacuaugcugccuccggggauccuaccucuccagacaauauugaaagccccaacgcaccuuggguguucgcuugcgccccagacaggugucccccgacgugcauauacguagcgggaauggccgagcuuggugcauuuuucuccaucuugcaggauaugcggaauacuauuauggcuucaaaaacagugggcaccgccgaagagaagcugaaaaagaaaaguagcuucuaccaaucuuaucuacgacgcacucaguccauggggauccagcucgaccagagaauaauucugcuuuacaugcuggaauggggaaaggagauggucgaucacuuucauuugggcgacgauauggacccugagcucaggggucuggcucaagccuuaaucgaucagaaggugaaagaaaucucaaaccaggagccccugaagauuuga

SEQ ID NO: 5817 - RNA, 1302 nt, Artificial Sequence
  derived and/or modified CDS sequence (opt3) from PUUV(Munga/Mg16/05)__GQ339487.1__N
augagcgaccugaccgauauccaggacgagauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuucaagcgacguauggcagaugccguaucuagaaagaagauggacaccaagccuacagauccaacuggcauagaaccggacgaucaucugaaagagaggucaagucuacgguacgggaacgugcucgacgucaaugcuaucgacauugaggaacccagcggacagaccgcagauugguauacaaucgguguguacguuauuggcuuuacccugccuaucauacuuaaggcccuguauauguuguccacucgcgggagacagacagugaaagagaacaagggaaccaggauccgguucaaagacgauacgucuuuugaagacauuaauggcauccgccgaccaaagcaccucuacgucucgaugcccacugcucaaucaaccaugaaggccgaggagcugacaccugguagauucaggacuauugugugcgggcuguuuccaacccagauccagguacggaacauaaugagccccguuaugggagugauuggcuucuccuuuuucgucaaagauugggcggaacguauccgcgaguuuauggaaaaggaguguccuuucauuaaaccagaagugaagccgggcacacccgcacaggagaucgaguuucucaaaaagaauaaaaucuauuucaugcaaagacaggacguguuagauaagaaccaugucgccgacauugauaagcugauagacuacgcugccaguggggauccuaccucuccagacaauaucgaaagccccaacgcaccuuggguuuuugcuugcgccccagacaggugucccccgacgugcauuuauguggcgggaauggccgagcuuggugcauucuucuccaucuugcaggauaugcggaauacuauaauggcuucaaaaacaguaggcaccgccgaagagaagcugaaaaagaaaaguagcuuuuaccaaucuuaccuacgacgcacucaguccauggggauucagcucgaccagagaaucauccugcuuuauaugcuggaauggggaaaggagaugguggaucacuuccauuugggcgacgauauggacccugagcucaggggucuggcucaagccuuaauugaucagaaggucaaagaaaucucaaaccaggagccccugaagauuuga

SEQ ID NO: 5818 - RNA, 1302 nt, Artificial Sequence
  derived and/or modified CDS sequence (opt3) from PUUV(Munga/Mg2/05)__GQ339486.1__N
augagcgaccugaccgauauccaggacgagauuacaagacacgaacaacagcucguggccgcuaggcagaaacuuaaagaugcagagcgggccgucgaaauggaccccgaugacguuaacaagaauacucugcaggcgcgccaacagacgguguccgcuuuggaggauaaauuagccgacuucaagcgacguauggcagaugccguaucuagaaagaagauggacaccaagccuacagauccaacuggcauagaaccggacgaucaucugaaagagaggucaagucuacgguacgggaacgugcucgacaugaaugcuaucgacauugaggaacccagcggacagaccgcagauugguauacaaucggugucuacgugauuggcuuuacccugccuaucauacuuaaggcccuguauauguuguccacucgcgggagacagacaguuaaagagaacaagggaaccaggauccgguucaaagacgauacgucuuuugaagacauuaauggcauccgccgaccaaagcaccucuacgugucgaugcccacugcucaaucaaccaugaaggccgaggagcugacaccugguagauucaggacuauugucugcgggcuguuuccaacccagauccaggugcggaacauaaugagccccguaaugggaguuauuggcuucuccuuuuucgugaaagauugggcggaacguauccgcgaguuuauggaaaaggaguguccuuucauuaaaccagaagucaagccgggcacacccgcacaggagaucgaguuucucaaaaagaauaaaaucuauuucaugcaaagacaggacguguuagauaagaaccauguggccgacauugauaagcugauagacuacgcugccaguggggauccuaccucuccagacaauaucgaaagccccaacgcaccuugggucuuugcuugcgccccagacaggugucccccgacgugcauuuauguugcgggaauggccgagcuuggugcauucuucuccaucuugcaggauaugcggaauacuauaauggcuucaaaaacagugggcaccgccgaagagaagcugaaaaagaaaaguagcuuuuaccaaucuuaccuacgacgcacucaguccauggggauucagcucgaccagagaaucauccugcuuuauaugcuggaauggggaaaggagaugguagaucacuuccauuugggcgacgauauggacccugagcucaggggucuggcucaagccuuaauugaucagaaggugaaagaaaucucaaaccaggagccccugaagauuuga

SEQ ID NO: 5819 - RNA, 1302 nt, Artificial Sequence
  derived and/or modified CDS sequence (opt3) from PUUV(PUU/Cg-Erft)__AJ238779.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggaucaaaaaguuuauggaaaaagaguguccuuucauuaagccagaagugaaaccgggcacacccagucaagaggcggaauuucucaagaugaaucggaucuauuucaugcagcgucaggaggucuuagauaagaaccauguugcagacaucgauaaacugauugacuacgccgcuucuggggauccuaccagcccagacaauauagaggcccccaacgcaccuuggguguuugcuugcgccccagaccgcugucccccgacgugcaucuauguagcgggaauggccgaacuuggugcauucuucuccauuuugcaagauaugagaaauacuaucauggcuucaaagacagugggcaccgccgaggaaaaacugaagaaaaagaguagcuuuuaccagucuuaccuaaggcggacucaguccauggggauacagcucgaccaacgaauuauccugcuuuauaugcuggaguggggaaaggaaauggucgaucacuuccauuugggcgacgauauggacccugagcuccgcggucuggcucaggccuuaaucgaucagaaagugaaggagauuucaaaccaggaaccccugaaaaucuga

SEQ ID NO: 5820 - RNA, 1302 nt, Artificial Sequence
  derived and/or modified CDS sequence (opt3) from PUUV(Puu/Kazan)__Z84204.1__N
augagcgaccugaccgauauccaggaggaaauuacaagacacgagcaacagcucguggucgccaggcagaaacuuaaagacgcugaacgggcaguugagguggaucccgacgauguaaacaagaauacucugcaggcccgccaacagacgguguccgcguuggaagacaaauuagcugauuacaagcgacguauggccgacgcagucucuagaaagaagauggauaccaagccuacagacccaacuggcauagagccggaugaccaucugaaagagaggucaagucuacgguaugggaacgugcucgauguuaaugccaucgacauugaggaacccagcggacagaccgcugacugguacacaaucgguguguaugucauuggcuucaccaucccuauaauccugaaggcacuuuacaugcuguccacucgcgggagacagacagugaaagaaaacaagggaaccaggauucgguuuaaagaugacacgucuuucgaggauaucaauggcauucgccgaccaaagcacuuguauguaucgaugcccacugcccaaucaaccaugaaggcugaggaacucacaccugguagauuuaggacuaucguuugcgggcuguucccaacccagauacaggugcggaacauuaugagccccgucaugggagugaucggcuuuaguuucuuugugaaagacuggccugagcguauucgcgauuucauggaaaaggaguccccauuuaucaaaccggaagucaagcccggcaccccugcccaggagaucgaguuccugaaaagaaauaggguuuacuuuaugacacggcaagacgugcucgauaagaaccauguagcggacauugauaaauuaauagacuaugcagccucuggggauccaacgagccccgacgacaucgaauccccuaaugcuccauggguguucgccugugcacccgaucgaugcccgccuacuuguauuuacgucgcuggaauggccgagcugggugcguuuuucucaauccuucaggacaugcgcaacacaauaauggccaguaagaccgugggcacugcagaagagaaguugaaaaagaaaagcucuuucuaccaguccuaucugagaaggacacaaucaauggggauucagcuagaucagcggaucauccuccuguacaugcuugaauggggaaaggagaugguugaccacuuucaucugggcgaugacauggaucccgaguugcgcggucucgcucagagccugauugaccaaaaagugaaggaaaucaguaaucaggagccauuaaagauuuga

SEQ ID NO: 5821 - RNA, 1302 nt, Artificial Sequence
  derived and/or modified CDS sequence (opt3) from PUUV(PUU/Mignovillard/CgY02/2005)__AM695638.1__N
augggcgaccugaccgauauccaggaggacauuacaagacacgaacaacagcucguggucgccaggcagaaguuaaaagaugcugagaaggcaguugaaauggaccccgaugacgugaacaaaaauacucugcaggcccggcaacagacgguaagcgcguuggaggauaaguuagcugacuucaaacgccgaauggccgaugcagugucccguaagaagauggacaccaaaccuacagauccaacugggauagaaccggacgaucaucugaaggagagaucuucacuaagguacggaaacguccucgacgugaaugccaucgacauugaggaacccaguggucagaccgcugauugguauacaaucggcguuuacgugauuggguuuacccugccuaucauacuuaaagcacuguauauguugagcacucggggacgccagacagucaaggagaacaaaggcaccagaaucagguucaaggacgauacguccuuugaagacauuaaugguauccggcgcccaaagcaccucuacgugucuaugcccacugcccaaucgaccaugaaagcugaggagcugacaccugggcgauucagaacuauuguaugcggacuguuuccaacccagauccagguuaggaacauaaugucacccgugaugggcgucauuggcuucagcuuuuucgugaaggauuggacagaccggauccgugaauuuauggagaaagaauguccuuucauuaagccagagaugaaaccggggacccccgcccaggaagcggaguuucucaagcgcaauaaaaucuauuucaugcaaagacaggauguguuagacaagaaccaugucgcagauaucgacaagcugauugauuacgccgcuaguggagacccuacguccccagacaauauagagucucccaacgccccuuggguuuuugcaugcgcuccagauaggugucccccgacuugcaucuauguggccgguauggcggaacuuggcgccuucuucagcauuuugcaggacaugcggaauacaaucauggcauccaaaaccguagggacugcugaggaaaagcugaaaaagaaaucaaguuuuuaccaaagcuaccuacgacgcacacagucuaugggaauacagcucgaucagagaauuauccugcuuuauaugcuggaguggggcaaggaaaugguggaccacuuccauuugggugaugacauggauccugagcucagggggcuggcccaagcucuuaucgaccagaaggucaaagagauuuccaaccaggaaccccugaagaucuga

SEQ ID NO: 5822 - RNA, 1302 nt, Artificial Sequence
  derived and/or modified CDS sequence (opt3) from PUUV(PUUV/Croatia_Gerovo/Mg938/2008)__KC676609.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugaugggcuuuacccugccuauuauccuuaaagcacuguauauguuguccacucgggggcgccagacagucaaggagaacaaaggaaccagaauaagguucaaggacgauacgucuuuugaagacaucaauggcauucggcgcccaaagcaccucuacgugucgaugcccacugcccaaucaaccaugaaagcugaggagcugacaccuggucgauucagaacuaucguaugcgggcuguuuccaacccagauucagguuaggaacaucaugagccccgugaugggagucauaggcuucuccuuuuucgugaaggauuggagugaacgggugcgugacuuuauggagaaagaauguccuuucauuaagccagagaucaaaccgggcacaccccagcaagaagccgaguuucucaagcgcaauaaagucuauuucaugcagagacaggauguuuuagacaagaaccauguggcggauauugacaagcugaucgauuacgcagccucuggggacccuaccagcccagacaauaucgagucccccaacgcuccuuggguauuugccugcgcaccagauaggugucccccgacgugcauuuauguggcuggaauggccgaacuuggugcguucuucucaauauugcaagacaugcggaauacuaucauggccaguaaaacagucggcaccgcagaggaaaagcugaaaaagaaaagcucuuuuuaccaguccuaccuacgacgcacucagucaauggggauucagcucgaucaaagaaucauacugcuuuauaugcuggaguggggaaaggaaaugguggaccacuuccauuugggcgaugacauggauccugagcucaggggucuggcucaggccuuaauugaccagaagguuaaagagaucagcaaccaggaaccccugaagaucuga

SEQ ID NO: 5823 - RNA, 1302 nt, Artificial Sequence
  derived and/or modified CDS sequence (opt3) from PUUV(PUUV/Croatia_Gerovo/Mg979/2008)__KC676613.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauuggagugaacgggugcgugacuuuauggagaaagaauguccuuucaucaagccagagauuaaaccgggcacacccccucaggaagccgaguuucucaagcgcaauaaagucuauuucaugcaaagacaggauguuuuagacaagaaccauguggcggauaucgacaagcugaucgauuacgcagccucuggggacccaaccagccccgacaauauugaguccccuaacgcuccauggguauuugccugcgcacccgauagguguccgccuacgugcauauauguggcuggaauggccgaacuuggugcguucuucucaaucuugcaggacaugcggaauacuauuauggccaguaaaacagucggcaccgcagaggaaaagcugaaaaagaaaagcucuuuuuaccaauccuaccuacgacgcacucagucaauggggauccagcucgaucagagaauaauucugcuuuauaugcuggaguggggaaaggaaaugguggaccacuuccauuugggcgaugacauggaucccgagcucaggggucuggcucaagccuuaaucgaccagaagguuaaagagaucagcaaccaggaaccacugaagauuuga

SEQ ID NO: 5824 - RNA, 1302 nt, Artificial Sequence
  derived and/or modified CDS sequence (opt3) from PUUV(PUUV/Konnevesi/Mg_M114B/2005)__JQ319171.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauuggccugaacguauccgcgaguucauggaaaaggaguguccauuuauuaaaccggaagucaagcccggcaccccugcccaggagaucgagaugcucaaaagaaauaagaucuacuucaugcaaaggcaggacguuuuagauaaaaaccauguggcggacauugauaagcugauagacuaugcagccuccggggauccaacaucucccgacaauaucgacagcccuaacgcuccauggguauuugccugcgcacccgaucgguguccgccuacgugcauuuacguggcuggaauggccgaacuuggugcguucuuuuccaucuugcaggacaugcgaaauacuauaauggccucaaagacagucggcaccgcagaggaaaaacugaagaaaaagaguagcuucuaccaaucuuaucuacgcagaacucaguccauggggauucagcucgaucagaggaucauccugcuuuucaugcuggaguggggaaaagaaaugguggaccacuuucauuucggcgaugacauggaucccgaguugcggggucucgcucaagcccugauugaccagaagguuaaggagaucucaaaccaggaaccauuaaaaauuuga

SEQ ID NO: 5825 - RNA, 1302 nt, Artificial Sequence
  derived and/or modified CDS sequence (opt3) from PUUV(PUUV/Konnevesi/Mg_M94A/2005)__JQ319163.2__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauuggccugaacguaucaaggaguucauggaaaaagaguguccauuuauuaagccggaagucaaacccggcaccccugcccaggagaucgagaugcucaagcgcaauaaaaucuacuucaugcaaagacaggacguuuuagauaagaaccauguggcggacauugauaagcugauagacuaugcagccuccggggauccaacaucucccgacaauaucgacagcccuaacgcuccauggguauuugccugcgcacccgauagguguccgccuacgugcauuuacguggcuggaauggccgaacuuggugcguucuuuuccaucuugcaggacaugcggaauacuauaauggccucaaaaacagucggcaccgcagaggaagaggugaagaaaaagaguagcuucuaccaaucuuaucugcgacgcacucaguccauggggauucagcuagaucagagaaucauccuccuguucaugcuugaauggggaaaagagaugguugaccacuuucaucugggcgaugacauggaucccgaguugaggggucucgcucaagccaugauugaccagaaggugaaggaaaucucaaaccaggagccacugaaaauuuga

SEQ ID NO: 5826 - RNA, 1302 nt, Artificial Sequence
  derived and/or modified CDS sequence (opt3) from PUUV(PUUV/Konnevesi/Mg_O14B/2005)__JQ319166.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauuggccugaacguauccgcgaguucauggaaaaggaguguccauuuauuaaaccggaagucaagcccggcaccccugcccaggagaucgagaugcucaaaagaaauaagaucuacuucaugcaaaggcaggacguuuuagauaaaaaccauguggcggacauugauaagcugauagacuaugcagccuccggggauccaacaucucccgacaauaucgacagcccuaacgcuccauggguauuugccugcgcacccgaucgguguccgccuacgugcauuuacguggcuggaauggccgaacuuggugcguucuuuuccaucuugcaggacaugcgaaauacuauaauggccucaaagacagucggcaccgcagaggaaaaacugaagaaaaagaguagcuucuaccaaucuuaucuacgcagaacucaguccauggggauucagcucgaucagaggaucauccugcuuuucaugcuggaguggggaaaagaaaugguggaccacuuucauuugggcgaugacauggaucccgagcuccggggucuggcucaagccuuaauugaccagaagguuaaggagaucucaaaccaggaaccacugaaaauuuga

SEQ ID NO: 5827 - RNA, 1302 nt, Artificial Sequence
  derived and/or modified CDS sequence (opt3) from PUUV(PUUV/Konnevesi/Mg_O22B/2005)__JQ319168.2__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauuggccugaacguauccgcgaguucauggaaaaggaguguccauuuauuaaaccggaagucaagcccggcaccccugcccaggagaucgagaugcucaaaagaaauaagaucuacuucaugcaaaggcaggacguuuuagauaaaaaccauguggcggacauugauaagcugauagacuaugcagccuccggggauccaacaucucccgaaaauaucgacagcccuaacgcuccauggguauuugccugcgcacccgaccgguguccgccuacgugcauuuacguggcuggaauggccgagcuuggugcguucuuuuccaucuugcaggauaugcgaaauacuauaauggccucaaagacagucggcaccgcagaagagaaacugaagaaaaagaguagcuucuaccaaucuuaucuacgcagaacucaguccauggggauucagcucgaccagaggaucauccugcuuuucaugcuggaauggggaaaagagaugguggaucacuuucauuugggcgacgauauggaccccgagcuccggggucacgcucaagcccugauugaucagaagguuaaggaaaucucaaaccaggagccauuaaaaauuuga

SEQ ID NO: 5828 - RNA, 1302 nt, Artificial Sequence
  derived and/or modified CDS sequence (opt3) from PUUV(PUUV/Konnevesi/Mg_O57A/2005)__JQ319161.2__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccggauccaggugcguaacauaaugagccccgucaugggagugauuggcuuuaguuucuuugugaaagauuggccugaacgcaucaaggaguucauggaaaaagaguguuccuuuauuaagccagaagucaaaccgggcacacccgcccaggagaucgagaugcucaagagaaauaaaaucuacuucaugcagaggcaagacguuuuagauaagaaccauguggcggacauugauaagcugauagacuaugcagccucuggggauccuaccagcccagacaauaucgacucccccaacgcuccuuggguauuugccugcgcaccagaucggugucccccgacgugcauuuacguggcuggaauggccgaacuuggugcguucuuuucaaucuugcaggacaugcgaaauacuauaauggccaguaaaacagucggcaccgcagaggaagaggugaagaaaaagagcucuuucuaccaguccuaucugcgcagaacucaaucaauggggauucagcuagaucagaggaucauccuccuguucaugcuugaauggggaaaagagaugguugaccacuuucaucugggcgaugacauggauccugaguugcggggucucgcucaggcccugauugaccaaaacgugaaggaaaucagcaaucaggagcccuuaaagauuuga

SEQ ID NO: 5829 - RNA, 1302 nt, Artificial Sequence
  derived and/or modified CDS sequence (opt3) from PUUV(PUUV/Konnevesi/Mg_O6B/2005)__JQ319164.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuagggccauuguuugcgggcuguucccaacucagauccaggugcggaacauaaugagccccgucaugggagugauuggcuuuaguuucuuugugaaagauuggccugaacguauccgcgaguucaugggcaaggaauguccauuuauuaaaccggaggucaagcccgggaccccugcgcaggaaaucgagaugcucaaaagaaauaagaucuacuucaugcaaaggcaggacguuuuagauaaaaaccauguggcagacauugauaagcugauagacuaugccgcuuccggagauccaacaucucccgacaauaucgacagcccuaacgccccauggguauuugcaugcgcucccgaucgguguccgccuaccugcauuuacguggccgguauggcggagcuuggcgccuucuuuuccaucuugcaggacaugcgaaauacgauaauggcaucaaagacugucgggacagcugaagagaaacugaagaaaaagaguagcuucuaccaaucuuaucuacgcagaacccaguccaugggcauucagcucgaucagaggaucauccugcuuuucaugcuggaauggggaaaagagaugguggaccacuuucauuugggugaugacauggaucccgaacuccgggggcuggcccaggcuuuaauugaccaaaagguuaaggagaucucaaaccaggagccacugaaaauuuga

SEQ ID NO: 5830 - RNA, 1302 nt, Artificial Sequence
  derived and/or modified CDS sequence (opt3) from PUUV(PUUV/Konnevesi/Mg_O74B/2005)__JQ319170.1__N
augagcgaccugaccgauauccaggaggacauuacaagacacgaacaacagcucguggucgccaggcagaaacuuaaagaugcugagcgggcaguugaaguggaccccgaugacguaaacaagaauacucugcaggcccgccaacagacgguguccgcguuggaggauaaauuagcugacuacaagcgacguauggccgaugcagucucuagaaagaagauggacaccaagccuacagauccaacuggcauagaaccggacgaucaucugaaagagaggucaagucuacgguaugggaacgugcucgacguuaaugccaucgacauugaggaacccagcggacagaccgcugauugguacacaaucgguguguaugucauuggcuucacccugccuaucauacuuaaggcacuguacauguuguccacucgcgggagacagacagugaaagagaacaagggaaccaggauccgguuuaaagacgauacgucuuucgaagacauuaauggcauccgccgaccaaagcaccucuauguaucgaugcccacugcccaaucaaccaugaaggcugaggagcugacaccugguagauuuaggacuauuguuugcgggcuguucccaacccagauccaggugcggaacauaaugagccccgucaugggagugauuggcuuuaguuucuuugugaaagauuggccugaacguauccgcgaguucauggaaaaggaguguccauuuauuaaaccggaagucaagcccggcaccccugcccaggagaucgagaugcucaaaagaaauaagaucuacuucaugcaaaggcaggacguuuuagauaaaaaccauguggcggacauugauaagcugauagacuaugcagccuccggggauccaacaucucccgacaauaucgacagcccuaacgcuccauggguauuugccugcgcacccgaucgguguccgccuacgugcauuuacguggcuggaauggccgaacuuggugcguucuuuuccaucuugcaggacaugcgaaauacuauaauggccucaaagacagucggcaccguggaggaaaaacugaagaaaaagaguagcuucuaccaaucuuaucuacgcagaacucaguccauggggauucagcucgaucagaggaucauccugcuuuucaugcuggaguggggaaaagaaaugguugaccacuuucauuugggcgaugacauggaucccgagcuccggggucuggcacaggcuuuaauugaccaaaaggugaaggagaucucaaaccaggaaccacugaaaauuuga

SEQ ID NO: 5831 - RNA, 1302 nt, Artificial Sequence
  derived and/or modified CDS sequence (opt3) from PUUV(PUUV/Konnevesi/Mg_O78A/2005)__JQ319162.2__N
augagcgaccugaccgauauccaggaggacauuacaagacacgaacaacagcucguggucgccaggcagaagcugaaagaugcugagaaggcaguugaaguggaccccgaugacguaaacaaaaauacucuucaggcccggcaacagacgguguccgcguuggaggauaaguuagcugacuacaaacgccgaauggccgaugcagucucucguaagaagauggacaccaaaccuacagauccaacuggcauagaaccggacgaucaucugaaggagagaucaagucuaagguaugggaacgugcucgacguuaaugccaucgacauugaggaacccagcggacagaccgcugauugguacacaaucgguguguaugucauuggcuucacccugccuaucauacuuaaagcacuguacauguuguccacucgggggcgccagacagugaaggagaacaaaggaaccagaaucagguuuaaggacgauacgucuuucgaagacauuaauggcauccggcgcccaaagcaccucuauguaucgaugcccacugcccaaucaaccaugaaagcugaggagcugacaccuggucgauuuagaacuauuguuugcgggcuguucccaacccagauccaggugaggaacauaaugagccccgucaugggagugauuggcuuuaguuucuuugugaaggauuggccugaacggauccgugaguucauggaaaaagaguguccauuuauuaagccggaagucaaacccggcaccccugcccaggagaucgagaugcucaagcgcaauaaaaucuacuucaugcaaagacaggacguuuuagauaagaaccauguggcggacauugauaagcugauagacuaugcagccuccggggauccaacaucucccgacaauaucgacagcccuaacgcuccauggguacuugccugcggacccgaaagguguccgccuacgugcauuuacguggcagguauggcugaguugggcgccuuuuucuccauccugcaggauaugcggaauacuauaauggcgucaaaaacagucgggagugacgaagugaagcuaaagaaaaagagcuuuuucuaccaauauuaccuccgacgcacccacucuaugggcauucagcuggaucagagaaucauccuucuguguauguuggaguggggaauugaaaugguugaccauuuccaccucggugaugacauggaucccgagcugaggggguuagcccaggcaaugaucgaccaaaaagugaaggagauuuccaaccaggaaccacugauaaucuga

SEQ ID NO: 5832 - RNA, 1302 nt, Artificial Sequence
  derived and/or modified CDS sequence (opt3) from PUUV(PUUV/Mg23/HungaryTR17/00)__FN377822.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccgaauggccgaugcagugucucguaagaagauggacaccaaaccuacagauccaacuggcauagaaccggacgaucaucugaaggagagaucaagucuaagguacgggaacguccucgacgugaaugccaucgacauugaggaacccagcggacagaccgcugauugguauacaaucgguguuuacgugauuggcuuuacccugccuaucauacuuaaagcacuguauauguuguccacucgggggcgccagacagucaaggagaacaaaggaaccagaaucagguucaaggacgauacgucuuuugaagacauuaauggcauccggcgcccaaagcaccucuacgugucgaugcccacugcccaaucaaccaugaaagcugaggagcugacaccuggucgauucagaacuauuguaugcgggcuguuuccaacccagauccagguuaggaacauaaugagccccgugaugggagucauuggcuucuccuuuuucgugaaggauuggagugaacgggugcgugaguuuauggaaaaagaguguccuuucaucaagccagaaauuaaaccgggcacacccccucaggaggccgaguuucucaagcgcaauaaagucuauuucaugcaaagacaggacguuuuagauaagaaccauguggcggacaucgauaagcugaucgacuacgcagccucuggggauccaaccagccccgacaauauugaauccccuaacgcuccauggguauuugccugcgcacccgacagguguccgccuacgugcauauauguggcuggaauggccgagcuuggugcguucuucucaaucuugcaggauaugcggaauacuauuauggccaguaaaacagucggcaccgcagaagagaagcugaaaaagaaaagcucuuuuuaccaauccuaccuacgacgcacucagucaauggggauccagcucgaccagagaauaauucugcuuuauaugcuggaauggggaaaggagaugguggaucacuuccauuugggcgacgauauggaccccgagcucaggggucuggcucaagccuuaaucgaucagaagguuaaagaaaucagcaaccaggagccacugaagauuuga

SEQ ID NO: 5833 - RNA, 1302 nt, Artificial Sequence
  derived and/or modified CDS sequence (opt3) from PUUV(PUUV/Mg9/HungaryTR17/00)__FN377821.1__N
augagcgaccuggccgauauccaggaggacauuaccagacacgaacaacagcucguggucgcuaggcagaaguuaaaagaugcagagaaggccguugaaauggaccccgaugacgugaacaaaaauacacugcaggcgcggcaacagacuguauccgcuuuggaggauaaguuagccgacuucaaacgccgaauggcagaugccgugucucguaagaagauggacacgaaaccuaccgauccaacaggcauagaaccggacgaucaucugaaggagagaucaagucuaagguacgggaacguccucgacgugaaugcuaucgacauugaggaacccagcggacagacugcagauugguauaccaucgguguuuacgugauuggcuuuacacugccuaucauacuuaaagcccuguauauguuguccacccgggggcgccagacugucaaggagaacaaaggaacaagaaucagguucaaggacgauaccucuuuugaagacauuaauggcauccggcgcccaaagcaccucuacgugucgaugcccacggcucaaucaacuaugaaagccgaggagcugaccccuggucgauucagaacaauuguaugcgggcuguuuccaacucagauccagguuaggaacauaaugagccccgugaugggagucauuggcuucuccuuuuucgugaaggauuggagugaacgggugcgugaguuuauggaaaaagaguguccuuucaucaagccagaaauuaaaccgggcacacccccucaggaggcggaguuucucaagcgcaauaaagucuauuucaugcaaagacaggacguuuuagauaagaaccauguggcagacaucgauaagcugaucgacuacgccgcuucuggggauccaaccagccccgacaauauugaauccccuaacgccccauggguauuugcaugcgcucccgacagguguccgccuaccugcauauauguggccggaauggcggagcuuggugccuucuucucaaucuugcaggauaugcggaauacgauuauggcaaguaaaacugucggcacagcugaagagaagcugaaaaagaaaagcucuuuuuaccaauccuaccuacgacgcacccagucaauggggauccagcucgaccagagaauaauucugcuuuauaugcuggaauggggaaaggagaugguggaucacuuccauuugggcgacgauauggaccccgagcucaggggucuggcccaagcucuuaucgaucagaagguuaaagaaaucagcaaccaggagccacugaagauuuga

SEQ ID NO: 5834 - RNA, 1302 nt, Artificial Sequence
  derived and/or modified CDS sequence (opt3) from PUUV(PUUV/NL/Mg1012/2010)__KU314900.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauuggccugaccggauccgugaguucauggaaaaagaauguccauuuauuaagccggaggugaaacccggcaccccugcccaggaagcggaguuccucaagcgcaauaaagucuacuuuaugcaaagacaggauguuuuagacaagaaccauguggcagauaucgacaagcugaucgauuaugccgcuuccggggacccaacaucucccgacaauauugagagcccuaacgccccauggguauucgcaugcgcucccgauagguguccgccuacgugcauauacguggccggaauggcggaacuuggugccuuuuucuccaucuugcaggacaugcggaauacuauuauggcaucaaaaacagucggcgcugccgaggaaaagcugaaaaagaaaaguagcuucuaccaaucuuaucuacgacgcacccaguccauggggauccagcucgaucagagaauaauucugcuuuacaugcuggaguggggaaaggaaaugguggaccacuuucauuugggcgaugacauggaucccgagcucaggggucuggcucaagccuuaaucgaccagaagguuaaagagaucucaaaccaggaaccacugaagauuuga

SEQ ID NO: 5835 - RNA, 1302 nt, Artificial Sequence
  derived and/or modified CDS sequence (opt3) from PUUV(PUUV/NL/Mg1439/2011)__KU314901.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggagccagaaucagguuuaaggacgauaccucuuucgaagacauuaauggcauccggcgcccaaagcaccucuaugugucgaugcccacggcucaaucaacuaugaaagccgaggagcugaccccuggucgauuuagaacaauuguaugcgggcuguucccaacucagauccagguuaggaacauaaugagccccgugaugggagucauuggcuuuaguuucuuugugaaggauuggccugaccggauccgugaguucauggaacgcgaauguccauuuauuaaaccggaggugaagcccggcaccccugcgcaggaagcagaguuccucaaaagaaauaaggucuacuuuaugcaaaggcaggauguuuuagacaaaaaccauguggccgauaucgacgagcugaucgauuaugcugccuccggggacccaacaucucccgacaauauugaaagcccuaacgcaccauggguauucgcuugcgcccccgaucgguguccgccuaccugcauauacguggcgggaauggccgagcuuggugcauuuuucuccaucuugcaggacaugcgaaauacgauuauggcuucaaagacugucggcacagccgaagagaagcugaaaaagaaaaguagcuucuaccaaucuuaucuacgcagaacccaguccauggggauccagcucgaucagaggauaauucugcuuuacaugcuggaauggggaaaggagaugguggaccacuuucauuugggcgaugacauggaucccgagcuccggggucuggcucaagccuuaaucgaccagaaaguuaaggaaaucucaaaccaggagccacugaagauuuga

SEQ ID NO: 5836 - RNA, 1302 nt, Artificial Sequence
  derived and/or modified CDS sequence (opt3) from PUUV(PUUV/NL/Mg2/2008)__KU314902.1__N
augagcgaccugaccgauauccaggaggacauuacaagacacgaacaacagcucguggucgccaggcagaaacuuaaggaugcugagaaggcaguugaaauggaccccgaugacgugaacaaaacuacgcugcaggcccggcaacagaccguauccgcguuggaggauaaguuagcugacuucaaacgccagauggccgaugcagugucucgaaagaagauggacacaaaaccugccgauccaacuggcauagaaccggacgaucaucugaaggagcguucaagucuaagauacgggaauguccucgacgugaacgcuaucgacauugaggaacccagcggacagaccgcagauugguauacaaucgguguuuacgugauuggcuuuacccugccuaucauacuuaaagcccuguauauguuguccacuagggggcggcaaacagucaaggagaauaaaggaacccgcaucagauucaaggacgauacgucuuuugaagacauuaacggcaucaggcggccaaagcaccucuacgugucgaugcccacugcucagucaaccaugaaagccgaggagcugacaccuggucgcuuccgaacuauuguaugcgggcuguuuccaacccagauccagguuagaaauauaaugagccccgugaugggagucauuggcuucuccuuuuucgugaaggauugggcggacaggauccgggaauuuauggagaaagaauguccuuucauuaagccagaugugaaaccgggcacacccgcacaagaggccgaauuucucaagcguaacaaaaucuauuucaugcagcgccaggaggucuuagacaagaaucauguugcugauaucgacaagcugauugauuacgccgcaaguggggacccuaccucuccagacaacauagagagccccaauuccccuuggguguuugcuugcgccccagauagaugucccccgacgugcaucuauguagcgggaauggccgaacuuggugcauucuucucaauuuugcaagacaugaggaacacuaucauggcuaguaaaacagugggcaccgccgaggaaaagcugaaaaagaaaagcucuuuuuaccaguccuaccuacggcgaacucagucaauggggauacagcucgaucaacgcauuauccugcuuuauaugcuggaguggggaaaggaaauggucgaccacuuccauuugggcgaugacauggauccugagcucagaggucuggcucaggccuuaaucgaccagaagguggaggaaauuagcaaucaggagccccugaaaaucuga

SEQ ID NO: 5837 - RNA, 1302 nt, Artificial Sequence
  derived and/or modified CDS sequence (opt3) from PUUV(PUUV/NL/Mg25/2007)__KU314897.1__N
augagcgaccugaccgauauccaggaggacauuacaagacacgaacaacagcucguggucgccaggcagaaguuaaaagaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauuggccugaccggauccgugaguucauggaaaaagaauguccauuuauuaagccggaggugaaacccggcaccccugcccaggaagcggaguuccucaagcgcaauaaagucuacuuuaugcaaagacaggauguuuuagacaagaaccauguggcagauaucgacaagcugaucgauuaugccgcuuccggggacccaacaucucccgacaauauugagagcccuaacgccccauggguauucgcaugcgcucccgauagguguccgccuacgugcauauacguggccggaauggcggaacuuggugccuuuuucuccaucuugcaggacaugcggaauacuauuauggcaucaaaaacagucggcaccgcugaggaaaagcugaaaaagaaaaguagcuucuaccaaucuuaucuacgacgcacucaguccauggggauccagcucgaucagagaauaauucugcuuuacaugcuggaguggggaaaggaaaugguggaccacuuucauuugggcgaugacauggaucccgagcucaggggucuggcccaagcucuuaucgaccagaagguuaaagagaucucaaaccaggaaccacugaagauuuga

SEQ ID NO: 5838 - RNA, 1302 nt, Artificial Sequence
  derived and/or modified CDS sequence (opt3) from PUUV(PUUV/NL/Mg31/2007)__KU314896.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuacaaacgccgaauggccgaugcagugucucguaagaagauggacaccaaaccuacagauccaacuggcauagaaccggacgaucaucugaaggagagaucaagucuaagguaugggaacguccucgacgugaaugccaucgacauugaggaacccagcggacagaccgcugauugguacacaaucgguguuuaugugauuggcuucacccugccuaucauacuuaaagcacuguacauguuguccacucgggggcgccagacagucaaggagaacaaaggaaccagaaucagguuuaaggacgauacgucuuucgaagacauuaauggcauccggcgcccaaagcaccucuaugugucgaugcccacugcccaaucaaccaugaaagcugaggagcugacaccuggucgauuuagaacuauuguaugcgggcuguucccaacccagauccagguuaggaacauaaugagccccgugaugggagucauuggcuuuaguuucuuugugaaggauuggccugaccggauccgugaguucauggaaaaagaauguccauuuauuaagccggaggugaaacccggcaccccugcccaggaagcggaguuccucaagcgcaauaaagucuacuuuaugcaaagacaggauguuccagacaagaaccauguggcagauaucgacaaguuaaucgauuaugccgcuuccggggaccccacaucuccugacaauauugagagcccaaacgcccccuggguauucgcaugcgcuccggauagguguccucccacgugcauauacguggccggaauggcggaacugggugccuuuuucuccauccuucaggacaugcggaauacuauuauggcaucaaaaacagucggcaccgcugaggaaaaguugaaaaagaaaaguagcuucuaccaaucuuaucugcgacgcacucaguccauggggauccagcuagaucagagaauaauucuccuguacaugcuugaguggggaaaggaaaugguggaccacuuucaucugggcgaugacauggauccagaguugaggggucucgcccaagcucugaucgaccagaagguuaaagagaucucaaaccaggaaccuuuaaagauuuga

SEQ ID NO: 5839 - RNA, 1302 nt, Artificial Sequence
  derived and/or modified CDS sequence (opt3) from PUUV(PUUV/NL/Mg502/2008)__KU314904.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccugccgauccaacaggcauagaaccggacgaucaucugaaggagcguucaagucuaagauacgggaacguccucgacgugaaugcuaucgacauugaggaacccagcggacagacugcagauugguauaccaucgguguuuacgugauuggcuuuacacugccuaucauacuuaaagcccuguauauguuguccaccagggggcggcaaacugucaaggagaacaaaggaacacgcaucagauucaaggacgauaccucuuuugaagacauuaauggcaucaggcggccaaagcaccucuacgugucgaugcccacggcucagucaacuaugaaagccgaggagcugaccccuggucgcuuccgaacaauuguaugcgggcuguuuccaacucagauccagguuagaaacauaaugagccccgugaugggagucauuggcuucuccuuuuucgugaaggauugggcggacaggauccgggaauuuauggagaaagaauguccuuucauuaagccagaugugaaaccgggcacccccgcacaagaggccgaauuucucaagcguaauaaaaucuauuucaugcagcgccaggaggucuuagacaagaaccauguugcugauaucgacaagcugauugauuacgccgcaaguggggacccuacaucuccagacaauauagagagccccgauuccccuuggguguuugcuugcgccccagacagaugucccccgaccugcaucuauguagcgggaauggccgaacuuggugcauucuucucaauuuugcaagauaugaggaacacgaucauggcuaguaaaacugugggcacagccgaggaaaagcugaaaaagaaaagcucuuuuuaccaguccuaccuacggcgaacccagucaauggggauacagcucgaccaacgcauuauccugcuuuauaugcuggaguggggaaaggaaauggucgaucacuuccauuugggcgacgauauggacccugagcucagaggucuggcucaggccuuaaucgaucagaaggugaaagagauuagcaaucaggaaccccugaagaucuga

SEQ ID NO: 5840 - RNA, 1302 nt, Artificial Sequence
  derived and/or modified CDS sequence (opt3) from PUUV(PUUV/NL/Mg591/2008)__KU314905.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaugugaaaccgggcacacccgcgcaagaggcagaauuucucaagcguaauaaaaucuauuucaugcagcgccaggaggucuuagacaagaaccauguugccgauaucgacaagcugauugauuacgcugccaguggggacccuaccucuccagacaauauagagagccccaacuccccuuggguguuugcaugcgcuccagauagaugucccccgacgugcaucuauguagccggaauggcggaacuuggugccuucuucucaauuuugcaagacaugaggaauacuaucauggcaaguaaaacagugggcaccgcugaggaaaagcugaaaaagaaaagcucuuuuuaccaguccuaccuacggcgaacucagucaauggggauacagcucgaucaacgcauuauccugcuuuauaugcuggaguggggaaaggaaauggucgaccacuuccauuugggcgaugacauggauccugagcucagaagccuggcccaggcuuuaaucgaccagaaggugaaagagauuaguaaccaggaaccccugaagaucuga

SEQ ID NO: 5841 - RNA, 1302 nt, Artificial Sequence
  derived and/or modified CDS sequence (opt3) from PUUV(Samara_49/CG/2005)__AB433843.2__N
augagcgaccugaccgauauccaggaggaaauuacaagacacgagcaacagcucguggucgccaggcagaaacuuaaagacgcugaacgggcaguugagguggaucccgacgauguaaacaagaauacucugcaggcccgccaacagacgguguccgcguuggaagacaaauuagcugauuacaagcgacguauggccgacgcagucucuagaaagaagauggauaccaagccuacagacccaacuggcauagagccggaugaccaucugaaagagaggucaagucuacgguaugggaacgugcucgauguuaaugccaucgacauugaagaacccagcggacagaccgcugacugguacacaaucgguguguaugucauuggcuucaccaucccuauaauccugaaggcacuuuacaugcuguccacucgcgggagacagacagugaaagaaaacaagggaaccaggauucgguuuaaagaugacacgucuuucgaggauaucaauggcauucgccgaccaaagcacuuguauguaucgaugcccacugcccaaucaaccaugaaggcugaggaacucacaccugguagauuuaggacuaucguuugcgggcuguucccaacccagauacaggugcggaacauuaugagccccgucaugggagugaucggcuuuaguuucuuugugaaagacuggccugagcguauucgcgaguucauggagagagaauguccauuuaucaagccggaggucaaacccggcaccccugcccaggagguugaguuccugaagaggaaucggguguacuuuaugacacgacaagauguacucgacaaaaaccauguggcggauaucgacaaguuaauugauuaugcagccuccggggacccaacgucucccgaugacauagaaagcccuaaugcuccaugggucuucgccugcgcacccgaccgcuguccgccuacuugcaucuacguggcuggaauggccgaacugggugcguuuuucuccauucuucaggauaugagaaacacaaucauggccucaaaaaccguuggcacugcagaggaaaaguugaagaaaaagaguagcuucuaccagucuuaucugaggcggacacaauccauggggauacagcuagaccagcgcauuauccuccuguacaugcuugaguggggaaaagagaugguggaucacuuucaucugggcgacgauauggaccccgaauugagaggucucgcucagucacugaucgaucaaaaggucaaagagauuagcaaucaggaaccauuaaagaucuga

SEQ ID NO: 5842 - RNA, 1302 nt, Artificial Sequence
  derived and/or modified CDS sequence (opt3) from PUUV(Thuin/33Cg/96)__AJ277030.1__N
augagcgaccugaccgauauccaggaggacauuacaagacacgaacaacagcucguggucgccaggcagaaacuuaaggaugcugagaaggcaguugaaauggaccccgaugacgugaacaaaaauacucugcaggcccggcaacagacgguauccgcguuggaggauaaguuagcugacuucaaacgccagauggccgaugcagugucucgaaagaagauggacaccaaaccuacagauccaacuggcauagaaccggacgaucaucugaaggagcguucaagucuaagauacgggaacguccucgacgugaaugccaucgacauugaggaacccagcggacagaccgcugauugguauacaaucgguguuuacgugauuggcuuuacccugccuaucauacuuaaagcacuguauauguuguccacuagggggcggcaaacagucaaggagaacaaaggaacccgcaucagauucaaggacgauacgucuuuugaagacauuaauggcaucaggcggccaaagcaccucuacgugucgaugcccacugcccagucaaccaugaaagcugaggagcugacaccuggucgcuuccgaacuauuguaugcgggcuguuuccaacccagauccagguuagaaacauaaugagccccgugaugggagucauuggcuucuccuuuuucgugaaggauugggccgacaggauccgggaauuuauggagaaagaauguccuuucauuaagccagaggugaaaccgggcacacccguccaagaagcggaguuucucaagcguaauaaaaucuauuucaugcagcgccaggagguuuuagauaagaaccauguggcagacaucgauaagcugauugacuacgccgcuaguggggauccuaccucuccagacaauauagaagcccccaacgcaccuuggguauuugcuugcgccccagacagaugucccccgacgugcaucuauguggcgggaauggccgagcuuggugcauucuucagcauuuugcaagauaugaggaauacuaucauggcuuccaaaacagucggcaccgccgaagagaagcugaaaaagaaaucaaguuuuuaccagagcuaccuacggcgaacucagucuauggggauacagcucgaccaacgcauuauccugcuuuauaugcuggaauggggaaaggagaugguggaucacuuccauuugggcgacgauauggacccugagcucagaggucuggcucaggccuuaaucgaucagaagguuaaagaaauuuccaaccaggagccccugaagaucuga

SEQ ID NO: 5843 - RNA, 1302 nt, Artificial Sequence
  derived and/or modified CDS sequence (opt3) from PUUV(Udmurtia/338Cg/92)__Z30708.1__N
augagcgaccugaccgauauccaggaggaaauuacaagacacgagcaacagcucguggucgccaggcagaagcucaaagacgcugaacgggcaguugagguggaucccgacgauguaaacaagaauacucugcaggcccgccaacagacgguguccgcguuggaagacaaauuagcugauuacaagcgacguauggccgacucugucucaagaaagaagauggauaccaagccuacagacccaacuggcauagagccggaugaccaucugaaagagaggaguagcccccgguaugggaacgugcuagauguuaaugcaaucgacauugaggaaccuuccggacagaccgccgacugguacacaaucgguguguaugucauuggcuucaccaucccaauaauccucaaggcucuguacaugcuuucuacucgcgggagacagacaauuaaagaaaacaagggaaccaggauccgguuuaaagaugacacgucguucgaggauauuaauggcauccgccgacccaagcaccuguaugugucaaugccuacugcacaaagcaccaugaaggccgaggaauugacaccagguagauuuaggacuauaguaugcgggcuuuuccccacccagauucagguucggaacaucaugaguccugugaugggagucauuggcuuuuccuucuuugugaaagacuggccagagcguauccgcgauuucauggaaaaggaguguccguuuaucaaacccgaagugaagccuggcacaccagcucaggagauugaguuccugaaaagaaauagggucuacuuuaugacccggcaagacguucuggauaagaaccauguggccgacauagauaaacucaucgacuaugcggcaucuggggaucccacgagcccugacgacauugaauccccaaaugcccccuggguauucgcuugcgccccggaucgauguccucccacuugcaucuacguggcaggaauggcugaguuaggugccuuuuucucaauacugcaggacaugcgcaacacaauuauggcgaguaagaccgucggcacugccgaagagaaacuuaaaaagaaaagcucuuucuaccaguccuauuugagaaggacacaaucaauggggauccagcuggaucagcggaucauucuacucuacaugcuggaauggggaaaggagaugguggaccacuuucaucuuggcgaugacauggauccagagcugcgcgguuuggcacagagccucaucgaccaaaaaguuaaggaaauuaguaaucaggagccucugaagauauga

SEQ ID NO: 5844 - RNA, 1302 nt, Artificial Sequence
  derived and/or modified CDS sequence (opt3) from PUUV(Udmurtia/444Cg/88)__Z30706.1__N
augagcgaccugaccgauauccaggaggaaauuacaagacacgagcaacagcucguggucgccaggcagaaacuuaaagacgcugaacgggcaguugagguggaucccgacgauguaaacaagaauacucugcaggcccgccaacagacgguguccgcguuggaagacaaauuagcugauuacaagcgacguauggccgacgcagucucuagaaagaagauggauaccaagccuacagacccaacuggcauagagccggaugaccaucugaaagagaggucaagucuacgguaugggaacgugcucgauguuaaugccaucgacauugaggaacccagcggacagaccgcugacugguacacaaucgguguguaugucauuggcuucaccaucccuauaauccugaaggcacuuuacaugcuguccacucgcgggagacagacagugaaagaaaacaagggaaccaggauucgguuuaaagaugacacgucuuucgaggauaucaauggcauucgccgaccaaagcacuuguauguaucgaugcccacugcccaaucaaccaugaaggcugaggaacucacaccugguagauuuaggacuaucguuugcgggcuguucccaacccagauacaggugcggaacauuaugagccccgucaugggagugaucggcuuuaguuucuuugugaaagacuggccugagcguauucgcgauuucauggaaaaggaguguccauuuaucaaaccggaagucaagcccggcaccccugcccaggagaucgaguuccugaaaagaaauaggguuuacuuuaugacacggcaagacgugcucgauaagaaccauguagcggacauugauaaauuaauagacuaugcagccuccggggauccaacgucucccgacgacaucgaaagcccuaaugcuccauggguguucgccugcgcacccgaucgauguccgccuacuugcauuuacgucgcuggaauggccgagcugggugcguuuuucuccauccuucaggacaugcgcaacacaauaauggccucaaagaccgugggcacugcagaagagaaguugaaaaagaaaaguagcuucuaccagucuuaucugagaaggacacaauccauggggauucagcuagaucagcggaucauccuccuguacaugcuugaauggggaaaggagaugguugaccacuuucaucugggcgaugacauggaucccgaguugcgcggucucgcucagucacugauugaccaaaaagugaaggaaaucagcaaucaggagccauuaaagauuuga

SEQ ID NO: 5845 - RNA, 1302 nt, Artificial Sequence
  derived and/or modified CDS sequence (opt3) from PUUV(Udmurtia/894Cg/91)__Z21497.1__N
augagcgaccugaccgauauccaggaggaaauuacaagacacgagcaacagcucguggucgccaggcagaaacuuaaagacgcugaacgggcaguugagguggaucccgacgauguaaacaagaauacucugcaggcccgccaacagacgguguccgcguuggaagacaaauuagcugauuacaagcgacguauggccgacgcagucucuagaaagaagauggauaccaagccuacagacccaacuggcauagagccggaugaccaucugaaagagaggucaagucuacgguaugggaacgugcucgauguuaaugccaucgacauugaggaacccagcggacagaccgcugacugguacacaaucgguguguaugucauuggcuucaccaucccuauaauccugaaggcacuuuacaugcuguccacucgcgggagacagacagugaaagaaaacaagggaaccaggauucgguuuaaagaugacacgucuuucgaggauaucaauggcauucgccgaccaaagcacuuguauguaucgaugcccacugcccaaucaaccaugaaggcugaggaacucacaccugguagauuuaggacuaucguuugcgggcuguucccaacccagauacaggugcggaacauuaugagccccgucaugggagugaucggcuuuaguuucuuugugaaagacuggccugagcguauucgcgauuucauggaaaaggaguguccauuuaucaaaccggaagucaagcccggcaccccugcccaggagaucgaguuccugaaaagaaauaggguuuacuuuaugacacggcaagacgugcucgauaagaaccauguagcggacauugauaaauuaauagacuaugcagccuccggggauccaacgucucccgacgacaucgaaagcccuaaugcuccauggguguucgccugcgcacccgaucgauguccgccuacuugcauuuacgucgugggaauggcugagcugggugccuuuuucuccauccuucaggacaugcgcaacacaauaauggcgucaaagaccguuggcacugccgaagagaaguugaaaaagaaaaguagcuucuaccagucuuaucugagaaggacacaauccauggggauucagcuagaucagcggaucauccuccuguacaugcuugaauggggaaaggagaugguggaccacuuucaucugggcgaugacauggaucccgaguugcgcggucucgcacagucacugauugaccaaaaagucaaggaaaucagcaaucaggagccauuaaagauuuga

SEQ ID NO: 5846 - RNA, 1302 nt, Artificial Sequence
  derived and/or modified CDS sequence (opt3) from PUUV(Fusong-Cr-247)__EF442087.1__N
augagcgaccugaaggauauccaggaggacauugccagacacgaacaacagcucguggucgcuaggcagaaacuucgggaugcagagaaggccguugaaauggaccccgaugacgugaacaauaacacccugcaggcgcgccaacagacaguauccgcuuuggaggauaaaauagccgacuucaagcgacguauggcagauaucgugucuaggaaaaagauggacacuaagccugccgauccaacgggcauugaaccggacgaucauuuaaaagagagaucaagucugcgguacgggaauguccuagacgugaacgcuaucgacauugaggaacccagcggacagaccgcagauugguauacaaucgguguuuacauaaucggcuuuacucucccuauuauccugaaggcccuuuauaugcuguccacccgcgggagacagacagugaaagagaauaagggaaccaggauucgguucaaagacgauacuucuuuugaagacgucaacggcauccgccgaccaaagcacuuguacgugucgaugcccacagcucaaucaaccaugaaggccgaggagcucacgccugguagauucaggacuauaguaugcgggcuguuuccaacccagauucagguucggaauacaaugagccccgugaugggagucaucggcuucuccuuuuucgcgaaagauuggccugaccguauuaaggaauuuauggagaaagaauguccauucaucaagccggaggugaaacccggcacuccugcaaaggaaguggagauccugaaacgcaacaagauuuauuuuaugcagagacaagauguccucgacaagaaucauguuccagauauagacaaauuaaucgauuacgccgcuaguggggaccccaccucuccugagaacauugacagcccaaaugcccccuggguguucgcaugcgcuccggauagguguccucccacaugcaucuauguagccggaauggcggaacugggugccuuuuucuccauacuucaggacaugcggaacaccauuauggcaucaaagacggugggcacugcugaggaaaaauugaagaaaaagaguagcuucuaccagucuuaccugcgacgcacacaauccauggggauccagcuagaucagagaaucauucuccuguauaugcuugaguggggaaaggaaauggucgaccacuuucaucugggcgaugacauggauccagaguugaggucacucgcccaggcucugaucgaccaaaaagugaaggagauuagcaaucaggaaccuuuaaaaauauga

SEQ ID NO: 5847 - RNA, 1302 nt, Artificial Sequence
  derived and/or modified CDS sequence (opt3) from MUV(11-4)__JX046484.1__N
augagcgaccugaaggagauccaggaagauauugccagacacgagcaacagcucguggucgcuaggcagaaacuucgggacgcagaaaaggccguugagguggaucccgacgauguaaacaaaaauacccugcaggcgcgccaacagacaguguccgcuuuggaagacaaguuagccgauuucaaacgacagauggcagacuuugucucucguaagaagauggauacuaaaccuacggacccaaccggcauagagccggaugaccaucugaaggagagaucaagucuaagguacgggaacgugcucgauguuaaugccaucgacauugaggaacccagcggacagacagcugacugguauacuaucgguguguacauuaucggcuucacccugccuauaguccuuaaagcacuguauauguuguccacacgggggcgccaaaccgugaaggaaaacaaaggaacuagaaucagguuuaaggaugacacaucuuucgaggauauuaauggcauccggcgcccaaagcaccucuacguaucgaugcccaccgcccagucaacgaugaaagcugaggaacugacuccuggucgauuuagaaccauuguuugcgggcuguucccaacacagauccaggugaggaacauaaugagccccgucaugggagugauuggcuuuaguuucuuugugaaggacugggccgaucggaucaaagaguucauggaaaaggaguguccuuuuauuaaaccagaaccgaagcccggcacuccugcguccgaggucgaguuccucaaacguaauaagaucuauuuuaugucucgccaagacguuuuagauaagaaccaugugccagacaucgauaaacugauugacuacgcagccagcggggaucccaccuccccugacaauauagaagacccaaacgcucccuggguauucucaugcgccccggauagauguccucccacaugccuuuauguggcaggaauggcugaguugggugccuucuuuaguauccugcaggacaugaggaauaccauuauggcgagcaagacggucggcacugccgaagagaaacuaaagaaaaagucuuccuucuaccagucauaccuccggcgaacacaaagcauggggauccagcuggaucagcgcauaauucuucuguauauguuggaauggggaaaggagaugguggaccacuuucaucucggcgaugacauggauccagagcugagaaccuuagcacaggcucugaucgaccaaaaaguuaaggaaaucaguaaccaggagccucucaaaauuuga

SEQ ID NO: 5848 - RNA, 1302 nt, Artificial Sequence
  derived and/or modified CDS sequence (opt3) from MUV(00-18)__DQ138128.1__N
augagcgaccugaaggagauccaggaagauauugccagacacgagcaacagcucguggucgcuaggcagaaacuucgggacgcagaaaaggccguugagguggaucccgacgauguaaacaaaaauacccugcaggcgcgccaacagacaguguccgcuuuggaagacaaguuagccgauuucaaacgacagauggcagacuuugucucucguaagaagauggauacuaaaccuacggacccaaccggcauagagccggaugaccaucugaaggagagaucaagucuaagguacgggaacgugcucgauguuaaugccaucgacauugaagaacccagcggacagacagcugacugguauacuaucgguguguacgucauuggcuucacccugccuaucgugcuuaaagcacuguauauguuguccacacgggggcgccaaaccguaaaggaaaacaaaggaacuagaauaagguuuaaggaugacacaucuuucgaggauaucaauggcauucggcgcccaaagcaccucuacguuucgaugcccaccgcccagucaacgaugaaagcugaggaacugacuccuggucgauuuagaaccaucgugugcgggcuguucccaacacagauucaggucaggaacaucaugagccccgugaugggagugauaggcuuuaguuucuuugucaaggacuggguugagcggauuaaagaguucauggagaaggaauguccuuuuaucaaaccagagccgaagcccggcacuccugccuccgagguggaguuccucaaacguaauaagauuuauuuuaugaaccgccaagauguauuagacaagaaucaugugccagauaucgacaaacugaucgauuacgcggcaucuggggaccccaccagcccugauaacauugaagacccaaaugcccccugggucuucuccugcgcuccggacagauguccucccacaugccuuuauguggccggaauggcagaauugggugcuuucuuuucaauacugcaggauaugaggaacaccaucauggccaguaagacgguuggcacugcggaggaaaaacuaaagaaaaagagcucuuucuaccaguccuaccuccggcgaacacaaucaauggggauucagcuggaccagcgcaucauacuucuguauauguuggaguggggaaaggagaugguggaucacuuucaucucggcgacgauauggacccagaacugagaaccuuagcccaggcacugauugaucaaaaagucaaggagaucagcaaucaggaaccucucaaaaucuga

SEQ ID NO: 5849 - RNA, 1302 nt, Artificial Sequence
  derived and/or modified CDS sequence (opt3) from MUV(11-1)__JX028273.1__N
augagcgaccugaaggagauccaggaagauauugccagacacgagcaacagcucguggucgcuaggcagaaacuucgggacgcagaaaaggccguugagguggaucccgacgauguaaacaaaaauacccugcaggcgcgccaacagacaguguccgcuuuggaagacaaguuagccgauuucaaacgacagauggcagacuuugucucucguaagaagauggauacuaaaccuacggacccaaccggcauagagccggaugaccaucugaaggagagaucaagucuaagguacgggaacgugcucgauguuaaugccaucgacauugaggaacccagcggacagacagcugacugguauacuaucgguguguacauuaucggcuucacccugccuauaguccuuaaagcacuguauauguuguccacacgggggcgccaaaccgugaaggaaaacaaaggaacuagaaucagguuuaaggaugacacaucuuucgaggauauuaauggcauccggcgcccaaagcaccucuacguaucgaugcccaccgcccagucaacgaugaaagcugaggaacugacuccuggucgauuuagaaccauuguuugcgggcuguucccaacacagauccaggugaggaacauaaugagccccgucaugggagugauuggcuuuaguuucuuugugaaggacugggccgaucggaucaaagaguucauggaaaaggaguguccuuuuauuaaaccagaaccgaagcccggcacuccugcguccgagaucgaguuccucaaacguaauaagaucuauuuuaugucucgccaagacgucuuagauaagaaccauguuccagacauugauaaacugauagacuacgcagccagcggggaucccaccuccccugacaauaucgaagacccaaacgcucccuggguguucucaugcgccccggauagauguccucccacaugccuuuauguagcaggaauggcugaguugggugccuucuuuaguauucugcaggacaugaggaauaccaucauggcgagcaagacggugggcacugccgaagagaaacuaaagaaaaagucuuccuucuaccagucauaccuccggcgaacacaaagcauggggauacagcuggaucagcgcauuauccuucuguauauguuggaauggggaaaggagauggucgaccacuuucaucucggcgaugacauggauccagagcugagaaccuuagcacaggcucugaucgaccaaaaagugaaggaaauuaguaaccaggagccucucaaaaucuga

SEQ ID NO: 5850 - RNA, 1302 nt, Artificial Sequence
  derived and/or modified CDS sequence (opt3) from MUV(96-1)__DQ138133.1__N
augagcgaccugaaggagauccaggaagauauugccagacacgagcaacagcucguggucgcuaggcagaaacuucgggacgcagaaaaggccguugagguggaucccgacgauguaaacaaaaauacccugcaggcgcgccaacagacaguguccgcuuuggaagacaaguuagccgauuucaaacgacagauggcagacuuugucucucguaagaagauggauacuaaaccuacggacccaaccggcauagagccggaugaccaucugaaggagagaucaagucuaagguacgggaacgugcucgauguuaaugccaucgacauugaggaacccagcggacagacagcugacugguauacuaucgguguguacgucauuggcuucacccugccuaucgugcuuaaagcacuguauauguuguccacacgggggcgccaaaccguaaaggaaaacaaaggaacuagaauaagguuuaaggaugacacaucuuucgaggauaucaauggcauucggcgcccaaagcaccucuacguuucgaugcccaccgcccagucaacgaugaaagcugaggaacugacuccuggucgauuuagaaccaucgugugcgggcuguucccaacacagauucaggucaggaacaucaugagccccgugaugggagugauacgguuuaguuuccucgucaaggacugguccgagaaaauuaaggaauuuauggagaaagaauguccuuucaucaagccagagccgaaacccggcacuccugccucugagauugaauuuuuaaagcguaauaagaucuauuucaugaaccgccaagauguucuggacaaaaaucaugugccagauaucgacaaacuuauugauuacgcggcaagcggcgaccccaccuccccugauaacauagaggccccaaaugcucccuggguauuuucaugcgccccggacagauguccucccacaugcuuguauguggcagggauggcugaacugggagccuucuucaguauccuacaggacaugaggaacaccauuauggcgagcaagacggucgguacugccgaggaaaagcucaaaaagaagucuuccuuuuaccagucauaccugcggcgaacacaaagcaugggcauccagcuugaucagcgcauaauucuguuguauaugcucgagugggggaaagagaugguggaccacuuccaucugggagaugacauggauccagaauuaagaacccuggcacaggcucucaucgaccaaaagguuaaagagaucaguaaucaggaaccucuuaagauuuga

SEQ ID NO: 5851 - RNA, 1302 nt, Artificial Sequence
  derived and/or modified CDS sequence (opt3) from MUV(99-28)__DQ138142.1__N
augagcgaccugaaggagauccaggaagauauugccagacacgagcaacagcucguggucgcuaggcagaaacuucgggacgcagaaaaggccguugagguggaucccgacgauguaaacaaaaauacccugcaggcgcgccaacagacaguguccgcuuuggaagacaaguuagccgauuucaaacgacagauggcagacuuugucucucguaagaagauggauacuaaaccuacggacccaaccggcauagagccggaugaccaucugaaggagagaucaagucuaagguacgggaacgugcucgauguuaaugccaucgacauugaagaacccagcggacagacagcugacugguauacuaucgguguguacgucauuggcuucacccugccuaucgugcuuaaagcacuguauauguuguccacacgggggcgccaaaccguaaaggaaaacaaaggaacuagaauaagguuuaaggaugacacaucuuucgaggauaucaauggcauucggucgccaaagcaccucuacguuucaaugcccaccgcccagagcacgaugaaagcugaggaacugacuccuggucgcuuucgaaccaucgugugcgggcuguucccaacacagauucaggucagaaacaucaugagucccgugaugggagugauaggcuuuuccuucuuugucaaggacuggguugagaggauuaaagaguucauggagaaggaauguccuuuuaucaaaccagagccgaagcccggcacuccugccucugagguggaguuccucaaacggaauaagauuuauuuuaugaaccgucaagauguauuagacaagaaucaugugccagauaucgacaaacugaucgauuacgcggcaagcggggaccccaccuccccugauaacauugaagacccaaaugcccccugggucuucucaugcgcuccggaccgcuguccucccacaugccuuuauguggccggaauggcagaauugggugcuuucuuuaguauacugcaggauaugagaaacaccaucauggccagcaagacgguuggcacugcggaggaaaaacuaaagaaaaagucuuccuucuaccagucauaccucaggcggacacaaagcauggggauucagcuggaccagcgaaucauacuucuguauauguuggaguggggaaaggagaugguggaucacuuucaucucggcgacgauauggacccagaacugcgcaccuuagcccaggcacugauugaucaaaaagucaaggagaucaguaaucaggaaccucucaaaaucuga

SEQ ID NO: 5852 - RNA, 1290 nt, Artificial Sequence
  derived and/or modified CDS sequence (opt3) from SANGV(SA14)__NC_034526.1__N
auggccacccuggaggaaauccagaaggagauuaacauacacgaaggccaacucaucauugcuaaacagaaggugaaagacgcagagaagcaguacgaaaaagaucccgacgaucuuaauaagagagcccugagcgacagggaggggaucgcgcauuccauucagucuaagaucgaugaguugcggcgccaauuagcugaccgagucgccgcaggacguaaccugggucaggaaagagauccuacaggcguugagccaggggaccaccuaagggaaaaaucaaugcucaguuauggaaaugugauagaucugaaccaucuugacaucgaugagccgacuggccagacggccgacuggcugagcauuguaaucuacuugaccuccuucgugguccccauucuccugaaggcucuguauaugcucacaacucggggucgccagaccacaaaagauaauaaggggaugagaaucagguuuaaagacgacucuucguucgaggaugugaacggaauacggaagccuaagcacuuauuucugucaaugccaaaugcacaaagcaguaugaaagccgaagagauuacccccggccgcuuccgaacugcuguuugcggccuuuacccugcccagaucaaggcgagaaacaugguguccccagucaugucugugauuggguuuaucacauuggcaagggacuggaccgaacggaucgagaauuggcuggaucagcccuguaaauucaugagcgaaccuucccagacgucacuacaaaagggaccagccacuaaccgugacuaucucaaucagcgccaggcuagucuggcccaaauggagaccaaagaggcacaggcuguaagacagcaggccguugaugcggguugcaaccuuguggaccauauugauagcccgucuuccauaugggucuuugccggcgcacccgacagguguccuccaacaugccuguucaucucagggauggcugaauugggagccuuuuucagcauucuccaagauaugcggaauacuaucauggcuaguaagaccgugggcacaucugaggaaaaacugcgaaagaaguccagcuuuuaccagucguauuuacgcagaacccagucuauggguauacagcuggaccaaaggauuaucaucauguucaugguggagugggggaaagaagccgucgauggauuucaccucggcgacgacauggaucccgagcuucgguccuucgcacaggcccugauugaccagaagguuaaagagaucucaaaccaggaaccuuugaagauuuga

SEQ ID NO: 5853 - RNA, 1290 nt, Artificial Sequence
  derived and/or modified CDS sequence (opt3) from SANGV(SA22)__JQ082303.1__N
auggccacccuggaggaaauccagaaggagauuaacauacacgaaggccaacucaucauugcuaaacagaaggugaaagacgcagagaagcaguacgaaaaagaucccgacgaucuuaauaagagagcccugagcgacagggaggggaucgcgcauuccauucagucuaagaucgaugaguugcggcgccaauuagcugaccgagucgccgcaggacguaaccugggucaggaaagagauccuacaggcguugagccaggggaccaccuaagggaaaaaucaaugcucaguuauggaaaugugauagaucugaaccaucuugacaucgaugagccgacuggccagacggccgacuggcugagcauuguaaucuacuugaccuccuucgugguccccauucuccugaaggcucuguauaugcucacaacucggggucgccagaccacaaaagauaauaaggggaugagaaucagguuuaaagacgacucuucguucgaggaugugaacggaauacggaagccuaagcacuuauuucugucaaugccaaaugcacaaagcaguaugaaagccgaagagauuacccccggccgcuuccgaacugcuguuugcggccuuuacccugcccagaucaaggcgagaaacaugguguccccagucaugucugugauuggguuuaucacauuggcaagggacuggaccgaacggaucgagaauuggcuggaucagcccuguaaauucaugagcgaaccuucccagacgucacuacaaaagggaccagccacuaaccgugacuaucucaaucagcgccaggcuagucuggcccaaauggagaccaaagaggcacaggcuguaagacagcaggccguugaugcggguugcaaccuuguggaccauauugauagcccgucuuccauaugggucuuugccggcgcacccgacagguguccuccaacaugccuguucaucucagggauggcugaauugggagccuuuuucagcauucuccaagauaugcggaauacuaucauggcuaguaagaccgugggcacaucugaggaaaaacugcgaaagaaguccagcuuuuaccagucguauuuacgcagaacccagucuauggguauacagcuggaccaaaggauuaucaucauguucaugguggagugggggaaagaagucguugauggauuucaccucggcgacgacauggaucccgagcuucgguccuucgcccaggcacugauugaccagaaggugaaagagaucucaaaccaggaaccuuugaagauuuga

SEQ ID NO: 5854 - RNA, 1290 nt, Artificial Sequence
  derived and/or modified CDS sequence (opt3) from SEOV(L99)__AF288299.1__N
auggccaccauggaggaaauccagagagagauuagcgcucacgaaggccaacuggugauagcaaggcagaaggucaaagacgccgagaagcaguacgaaaaagaucccgacgaucucaacaagcggacacuucaugaccgcgaguccguugcggcuucuauccagucaaaaauugaugagcugaagcgacaauuggccgaccguaucgcagccgggaagaauauuggacaggauagagacccuacugguguggaaccaggcgaucacuuaaaagagaggagugcucugagcuaugggaacacgcuagaccucaauucccuggauaucgacgaaccgaccggacagacagcagauuggcuuacuauaaucguauaccugaccucuuucgugguccccauuaucuugaaggcccucuauaugcugacaacccggggccgccagacuucgaaagacaacaaggguaugagaauuagguuuaaagacgauucaagcuacgaggacgugaaugggauccggaagccuaagcaucuguauguuaguaugccaaacgcucaauccucuaugaaagccgaggaaauaacacccggacgcuuccgaaccgcggugugcggccucuacccugcacagauuaaggccagaaauauggucagcccagugauguccguaguuggcuuuuuagcucuggccaaagauuggacgucaaggaucgaggaauggcuuggggcacccuguaaguucauggcugagaguccuauugccgguagcuugucuggaaacccagugaaucgggacuauauccgucagcgccagggcgcgcuggccgggauggaaccgaaagaguuucaagcacuaagacagcacgcuaaggaugccggaugcacucucgucgagcauaucgaaucccccucaagcauuuggguguucgcuggcgccccugacagguguccaccuaccugccuguuugugggugggauggcagagcuuggagccuucuuuaguauacugcaggauaugcggaacacaaucauggcuucuaaaacugucggcaccgcggacgaaaaguugcgaaagaaauccagcuucuaccaaucguaccuccgcagaacacagucuaugggcauucagcuggaucagaggaucauaguuauguuuaugguggcaugggggaaggaggccguauauaauuuccacuuaggagacgauauggaccccgaacugcggucccucgcucaaauucuuaucgaccagaaagugaaggagaucucaaaccaggagccaaugaaacuguga

SEQ ID NO: 5855 - RNA, 1290 nt, Artificial Sequence
  derived and/or modified CDS sequence (opt3) from SEOV(SG42/2011)__KY807171.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggucuacaauaaucguauaccuuacuucguucgugguccccauuauccugaaggcuuuguauaugcucaccacacggggccgccagaccucaaaagacaacaaggguaugagaauuagguuuaaagacgauagcaguuacgaggacgugaaugggauccggaagccuaagcaucuguauguuuccaugccaaacgcccaaucuagcaugaaagcggaggaaauaacucccggacgcuuccgaacagcagugugcggccuguacccugcccagauuaaggcuagaaauauggucuccccagugaugucaguaguuggcuuucucgccuuagcaaaagauuggaguagcaggaucgaggaauggcugggggcucccuguaaguucauggccgagucuccuauugcgggaucccuuucagguaacccagugaaucgggacuauauccgucagcgccagggcgccuuggcagggauggaaccgaaagaguuucaagcucugagacagcacagcaaggaugccggaugcacccuagucgagcauaucgaaagucccucuuccauuuggguguucgcuggcgccccugacagguguccacccacgugccucuuugugggugggauggcagagcugggagccuucuuuagcauacuucaggauaugcggaacacuaucauggcuucgaaaaccgucggcacagcggacgaaaagcugcgaaagaaaucuuccuucuaccaaucauacuugcgcagaacucagaguaugggcauucagcucgaucagaggaucauaguuauguuuaugguggcaugggggaaggaggccguagacaauuuccaccugggagaugacauggacccugaauuacggagccuggcucaaauucucaucgaucagaaagugaaggagaucuccaaccaggagccaaugaaacuuuga

SEQ ID NO: 5856 - RNA, 1290 nt, Artificial Sequence
  derived and/or modified CDS sequence (opt3) from SEOV(XJ2/2011)__KY807169.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggucgcgccagaccucaaaagacaacaagggcaugagaauuagguuuaaagacgauagcaguuacgaggacgugaaugguauccggaagccuaagcaucuguauguuuccaugccaaacgcccaaucuagcaugcgcgcggaggaaauaacucccgggcgauucagaacagcagugugcggacucuacccugcccagauuaaagcuaggaauauggucuccccagugaugucaguaguuggcuuuuuagcccuggcaaaggauuggaccagucggaucgaggaauggcuuggcgcucccuguaaauucauggccgagagcccuauugcggggucuuuguccggaaacccagugaaucgugacuauauccgccagagacagggugcccuggcaggcugggaaccgaaggaguuucaagcucuaaggcagcacucaaaagaugccgggugcacgcucgucgagcauaucgaaagccccaguucuauuuggguguucgcuggagccccugaccgguguccacccacuugccuguuugugggcgguauggcagagcuuggggccuucuuuuccauacugcaggauaugcgaaacaccaucauggcuagcaagacagucggaacugcggacgaaaaauugcgcaagaagucgucuuucuaccaauccuaccucagaaggacccagucaaugggcauucagcuggaucagcggaucauaguuauguuuaugguggcauggggcaaagaggccguagacaauuuccacuuaggggaugacauggacccugaacugcgcagucucgcucaaauucuuaucgaucagaaggugaaagagaucagcaaccaggagccaaugaagcuguga

SEQ ID NO: 5857 - RNA, 1290 nt, Artificial Sequence
  derived and/or modified CDS sequence (opt3) from SEOV(XJ5/2011)__KY807170.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcaccccaaggaugccggaugcacgcucgucgagcauaucgaauccccuucaagcauuuggguguucgcuggcgccccagacaggugucccccuacuugccuguuugugggugggauggcagagcuuggagccuucuuuaguauacugcaggauaugcggaacaccaucauggcuucuaaaacagucuccacugcggacgaaaaguugcgaaagaaaagcucguucuaccaaucuuaccuccgcagaacccaguccaugggcauucagcuggaucagaggaucauaguuauguuuaugguggcauggggcaaggaggccguagacaauuuccacuuaggggaugacauggacccagaacugcggucacucgcucaaauucuuaucgaucagaaagugaaggagaucaguaaccaggagcccaugaaacuguga

SEQ ID NO: 5858 - RNA, 1290 nt, Artificial Sequence
  derived and/or modified CDS sequence (opt3) from SEOV(10-134)__JF693882.2__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucguguugcccauuauccucaaggcucuguauaugcugaccacacggggccgccagaccucgaaagacaacaaggguaugagaauuagguuuaaagacgauucaagcuacgaggacgucaaugggauccggaagccuaagcaucucuaugugaguaugccaaacgcccaauccucuaugaaagcggaggaaauaacucccggacgcuuccgaacagcaguuugcggcuuauacccugcccagauuaaggcuagaaauauggugagcccagucauguccgugguaggcuuucuggcccuugcaaaagauuggaccucaaggaucgaggaaugguugggggcucccuguaaguucauggccgagaguccuauugcgggaagccugucugguaacccaguuaaucgggacuauauccgucagcgccagggcgcccuagcagggauggaaccgaaagaguuucaagcucucagacagcacuccaaggaugccggaugcacgcugguggagcauaucgaaucacccagcaguauuugggucuucgcuggcgccccugacagguguccacccacuugccuuuuugugggugggauggcagagcugggagccuucuuuucuauauugcaggauaugcggaacaccaucauggcuuccaaaacagugggcacugcggacgaaaagcuccgaaagaaaagcucguucuaccaaucuuaccugcgcagaacccaguccaugggcauucaguuagaucagaggaucauagucauguuuaugguugcaugggggaaggaggccguggacaauuuccaccugggagaugacauggacccugaacuccggucacuugcucaaauucugaucgaucagaaaguaaaggagaucaguaaccaggagccaaugaaauuguga

SEQ ID NO: 5859 - RNA, 1290 nt, Artificial Sequence
  derived and/or modified CDS sequence (opt3) from SEOV(DPRK08)__JX853575.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacgcucgucgagcauaucgaaucccccucaagcauuuggguguucgccggcgcaccugacagguguccacccacuugccuguuugugggugggauggccgagcuuggagcuuucuuuaguauacugcaggauaugcggaacaccaucauggcgucuaaaacagucggcacugcagacgaaaaguugcgaaagaaauccagcuucuaccaaucguaccuccgcagaacccagucuaugggcauucagcuggaucagaggaucauaguuauguuuaugguggccugggggaaggaggcuguagacaauuuccacuuaggagaugacauggacccugaacugcggucccucgcccaaauucuuaucgaucagaaagugaaggagaucucaaaccaggagccaaugaaacuguga

SEQ ID NO: 5860 - RNA, 1290 nt, Artificial Sequence
  derived and/or modified CDS sequence (opt3) from SEOV(Fj372/2013)__KP645198.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggauccccagugaaccgggacuauauccgucagcgccagggcgcccuggcagggauggaaccgaaagaguuucaagcucuaagacagcacgccaaggaugcuggaugcacgcucgucgagcauaucgaaucacccagcaguauuuggguguucgccggcgcaccugacagguguccacccacuugccuguuugugggugggauggccgagcuuggagcuuucuuuucuauacugcaggauaugcggaauaccaucauggcguccaaaacagucggcacugcagacgaaaaguugcgaaagaaaagcucguucuaccaaucuuaccuccgcagaacccaguccaugggcauucagcuggaucagaggaucauaguuauguuuaugguggccugggggaaggaggcuguagacaacuuccacuuaggagaugacauggacccugaacugcggucacucgcccaaauucuuaucgaucagaaagugaaggagaucaguaaucaggagccaaugaaacuguga

SEQ ID NO: 5861 - RNA, 1290 nt, Artificial Sequence
  derived and/or modified CDS sequence (opt3) from SEOV(HeB38)__JN377553.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugaaaauuagauuuaaggacgauucaagcuacgaggacgugaaugggaucaggaagccuaaacaucuguauguuaguaugccaaacgcccaauccucuaugaaggcggaggaaauaacucccggacgguuccgcacagcagugugcggccucuacccugcccagauuaaagcucgaaauauggucagcccagugauguccguaguuggcuuuuuagcccuggcaaaggauuggaccucaagaaucgaggaauggcuuggggcucccuguaaauucauggccgagaguccuauugcggguagcuugucuggaaacccagugaauagggacuauauccggcagcgucagggcgcccuggcagggauggaaccgaaggaguuucaagcucuacgccagcacuccaaagaugccggaugcacgcucgucgagcauaucgaaucacccagcaguauuuggguguucgcuggcgccccugacagauguccacccacuugccuguuugugggugggauggcagagcuuggagccuucuuuucuauacugcaggauaugaggaacaccaucauggcuuccaagacagucggcacugcggacgaaaaguugcggaaaaagagcccuuucuaccaaucguaccuccgacgcacccagucuaugggcauucagcuggaucagagaaucauaguuauguuuaugguggcaugggggaaagaggccguagacaauuuccacuuaggagaugacauggacccagaacugaggggucucgcucaaauucuuaucgaucagaaggugaaagagaucuccaaccaggagcccaugaagcuguga

SEQ ID NO: 5862 - RNA, 1290 nt, Artificial Sequence
  derived and/or modified CDS sequence (opt3) from SEOV(JiangxiXinjianRn-07-2011)__KP859511.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacuccaaggaugccggaugcacgcucgucgagcauaucgaaucacccagcaguauuuggguguucgcuggcgccccugacagguguccacccacuugccuguuugugggugggauggcagagcuuggagccuucuuuucuauacugcaggauaugcggaacaccaucauggcuuccaaaacagucggcacugcggacgaaaaguugcgaaagaaaagcucguucuaccaaucuuaccuccgcagaacccaguccaugggcauucagcuggaucagaggaucauaguuauguuuaugguggcaugggggaaggaggccguagacaauuuccacuuaggagaugacauggacccugaacugcggucacucgcucaaauucuuaucgaucagaaagugaaggagaucaguaaccaggagccaaugaaacuguga

SEQ ID NO: 5863 - RNA, 1290 nt, Artificial Sequence
  derived and/or modified CDS sequence (opt3) from SEOV(JiangxiXinjianRn-09-2011)__KP859512.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauucuccaugaaagcggaggaaauaacucccggacgcuuucgaacagcagugugcggccucuacccugcccagauuaaggcuagaaauauggucucuccagugaugagcguaguuggcuucuuagcccuggcaaaagauuggaccuccaggaucgaggaauggcuuggggcucccuguaaguuuauggccgagucaccuauugcgggaaguuugagcgguaacccagugaaucgggacuauauccgucagcgccagggcgcccuggcagggauggaaccgaaagaguuccaagcucuaagacagcacucuaaggaugccggaugcacgcucgucgagcauaucgaaucccccucaagcauuuggguguuugcuggcgccccugacagguguccacccacuugccuguucgugggugggauggcagagcuuggagccuuuuucaguauacugcaggauaugcggaacaccaucauggcuucuaaaacagucggcacugcggacgaaaaguugcgaaagaaauccagcuuuuaccaaucguaccuccgcagaacccagucuaugggcauucagcuggaucagaggaucauaguuauguucaugguggcaugggggaaggaggccguagacaauuuucacuuaggagaugacauggacccugaacugcggucccucgcucaaauucuuaucgaucagaaagugaaggagaucucaaaccaggagccaaugaaacuguga

SEQ ID NO: 5864 - RNA, 1290 nt, Artificial Sequence
  derived and/or modified CDS sequence (opt3) from SEOV(Singapore/06(RN41))__GQ274944.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacuccaaggaugccggaugcacgcucgucgagcauaucgaaucacccagcaguauuuggguguucgcuggcgccccugacagguguccacccacuugccuguuugugggugggauggcagagcuuggagccuucuuuucuauacugcaggauaugcggaacaccaucauggcuuccaaaacagucggcacugcggacgaaaaguugcgaaagaaaagcucguucuaccaaucuuaccuccgcagaacccaguccaugggcauucagcuggaucagaggaucauaguuauguuuaugguggcaugggggaaggaggccguagacaauuuccacuuaggagaugacauggacccugaacugcggggucucgcucaaauucuuaucgaucagaaagugaaggagaucucaaaccaggagccaaugaaacuguga

SEQ ID NO: 5865 - RNA, 1290 nt, Artificial Sequence
  derived and/or modified CDS sequence (opt3) from SEOV(YaluRiver12)__HQ611980.1__N
auggccaccauggaggaaauccagagagagauuagcgcucacgaaggccaacuggugauagcaaggcagaaggucaaagacgccgagaagcaguacgaaaaagaucccggggaccucaacaagcgggcgcuucaugaucgcgaguccguugcugccucuauccagucaaaaauugacgagcugaagcgacaauuggcagaucguaucgccgcuggaaagaauauuggucaggacagagauccuacaggcguggaaccaggggaccacuuaaaagagaggagugcacugagcuauggaaacacucuagaucucaauucccuggacaucgaugaaccgacgggccagaccgccgacuggcuuacaauaaucguauaccugacuucuuucgugguccccauuaucuugaaggcucucuauaugcugaccacacggggucgccagaccucgaaagauucaaaggggaugagaauuagguuuaaagacgacagcaguuacgaggaugugaacggaauccggaagccuaagcaucuguauguuuccaugccaaaugcccaaucuagcaugaaaacugaggaaauaacacccggccgcuuccgaaccgcggugugcggccucuacccugcacagauuaaggccagaaacauggucuccccagugaugucaguaguuggguuuuuagcucuggccaaagacuggacgaguaggaucgaggaauggcuuggagcacccuguaaguucauggcugagagcccuauugccgguucuuuguccgaaaauccagugaaccgggauuauauccgucagcgccagggcgcgcuggccgggauggagccgaaagaguuucaagcacuaagacagcacgcuaaggacgccggaugcacucucgucgaacauaucgagucacccagcaguauuuggguguucgcuggcgccccugauagguguccaccuaccugccuguuugugggugggauggcagaacuuggagccuucuuuucuauacugcaggacaugcggaauacaaucauggcuuccaaaacugucggcaccgcggaugagaaguugcgaaagaaaagcucguucuaccaaucuuaccuccgcagaacacaguccaugggcauucagcuggaccagaggaucauaguuauguuuaugguggcaugggggaaggaagccguagauaacuuccacuuaggagacgauauggaccccgagcugcggucacucgcucaaauucuuaucgaccagaaagugaaggagaucaguaaucaggaaccaaugaaacuguga

SEQ ID NO: 5866 - RNA, 1290 nt, Artificial Sequence
  derived and/or modified CDS sequence (opt3) from SEOV(14D12)__AB618124.1__N
auggccaccauggaggaaauccagaaggagauuagcgcucacgaaggccaacuggugauagcaagacagaaagucaaggacgccgagaaacaguacgaaaaggaucccgacgaucucaacaaaagggcgcuucaugaccgggaguccguugcugccucuauccagucaaagauugaugagcugaagcgccaauuggcagaccgaaucgccgcugggaaaaauauuggacaggaucgugacccuacagguguggaaccaggcgaucacuuaaaggagagaagugcacugagcuaugggaacacucuagaccucaauucccuggauaucgacgaaccgacgggacagaccgccgauuggcuuacaauaaucguauaccugacuucuuucgugguccccauuaucuugaaagcucucuauaugcugaccacaaggggccggcagaccucgaaggacaacaaagguaugcgcauuagauuuaaggacgauucaagcuacgaggacgugaaugggaucaggaagccuaaacaucuguauguuaguaugccaaacgcccaauccucuaugaaggcggaggaaauaacucccggacgguuccgcacagcagugugcggccucuacccugcccagauuaaagcucgaaauauggucagcccagugauguccguaguuggcuuuuuagcccuggcaaaggauuggaccucaagaaucgaggaauggcuuggggcucccuguaaauucauggccgagaguccuauugcggguagcuugucuggaaacccagugaauagggacuauauccggcagcgucagggcgcccuggcagggauggaaccgaaggaguuucaagcucuacgccagcacuccaaagaugccggaugcacgcucgucgagcauaucgaaucacccagcaguauuuggguguucgcuggcgccccugacagauguccacccacuugccuguuugugggugggauggcagagcuuggagccuucuuuucuauacugcaggauaugaggaacaccaucauggcuuccaagacagucggcacugcggacgaaaaguugcggaaaaagagcucguucuaccaaucuuaccuccgacgcacccaguccaugggcauucagcuggaucagagaaucauaguuauguuuaugguggcaugggggaaagaggccguagacaauuuccacuuaggagaugacauggacccugaacugaggucacucgcucaaauucuuaucgaucagaaggugaaagagaucaguaaccaggagccaaugaagcuguga

SEQ ID NO: 5867 - RNA, 1281 nt, Artificial Sequence
  derived and/or modified CDS sequence (opt3) from SEOV(19CSG)__AB618114.1__N
auggaggaaauccagagagagauuagcgcccacgaaggccaacuggugauagcuaggcagaaggucaaagacgcagagaagcaguacgaaaaagaucccgacgaucucaacaagcgggcccuucaugaccgcgaguccguugcggcuucuauccagucaaaaauugaugagcugaagcgacaauuggccgaccguaucgcagccgggaagaauauuggacaggauagagacccuaccgguguggaaccaggcgaucacuuaaaagagaggagugcucugagcuaugggaacacacuagaccucaauucccuggauaucgacgaaccgacuggacagacggcagauuggcuuaccauaaucguauaccugacaucuuucgugguccccauuaucuugaaggcccucuauaugcugacuacccggggccgccagacaucgaaagacaacaaggguaugagaauuagguuuaaagacgauucaagcuacgaggacgugaaugggauccggaagccuaagcaucuguauguuaguaugccaaacgcucaauccucuaugaaagccgaggaaauaacccccggacgcuuccgaacugcggugugcggccucuacccugcacagauuaaggccagaaauauggucagcccagugauguccguaguuggcuuuuuagcucuggccaaagauuggacaucaaggaucgaggaauggcuuggggcacccuguaaguucauggcugagaguccuauugccgguagcuugucuggaaacccagugaaucgggacuauauccgucagcgccagggcgcgcuggccgggauggaaccgaaagaguuucaagcacuaagacagcacuccaaggaugcuggaugcacccucgucgagcauaucgaaucacccagcaguauuuggguguucgccggcgcuccugacagguguccacccacgugccuguuugugggugggauggccgagcuuggagcauucuuuucuauacugcaggauaugcggaacacuaucauggccuccaaaaccgucggcacagcugacgaaaaguugcgaaagaaaagcucguucuaccaaucuuaccuccgcagaacucaguccaugggcauucagcuggaucagaggaucauaguuauguuuaugguggcgugggggaaggaggcaguagacaauuuccacuuaggagaugacauggacccugaacugcggucacucgcccaaauucuuaucgaucagaaagugaaggagaucaguaaccaggagccaaugaaacuguga

SEQ ID NO: 5868 - RNA, 1290 nt, Artificial Sequence
  derived and/or modified CDS sequence (opt3) from SEOV(93HBX12)__EF192308.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggaucggaaagccuaagcaucuguauguuaguaugccaaacgcccaauccucuaugaaagcggaggaaauaacucccggccgguuccgcacagcagugugcggccucuacccugcccagauuaaggcucgaaauauggucagcccagugauguccguaguuggguuuuuagcccuggcaaaagauuggaccucaagaaucgaggaauggcuuggagcucccuguaaguucauggccgagaguccuauugcggguagcuugucuggcaacccagugaauagggacuauauccggcagcgucagggggcccuggcaggaauggaaccgaaagaguuucaagcucuacgccagcacuccaaggaugccggcugcacgcucgucgagcauaucgaaucacccagcaguauuuggguguucgcuggugccccugacagauguccacccacuugccuguuugucgggggaauggcagagcuuggcgccuucuuuucuauacugcaggauaugaggaacaccaucauggcuuccaaaacagugggcacugcggacgaaaaguugcggaagaaaagcucguucuaccaaucuuaccuccgacgcacccaguccauggggauucagcuggaucagagaaucauaguuauguuuaugguggcauggggaaaggaggccguagacaauuuccacuuaggugaugacauggacccugaacugaggggccucgcucaaauucuuaucgaucagaaagugaaggagaucucaaaccaggagccaaugaaacuguga

SEQ ID NO: 5869 - RNA, 1290 nt, Artificial Sequence
  derived and/or modified CDS sequence (opt3) from SEOV(Cherwell)__KC626089.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauugccgagaguccuaucgcggguagcuugucuggaaacccagugaaucgggacuauauccgucagcgccagggcgcccuggcagggauggaaccgaaagaguuucaagcucuaagacagcacuccaaggaugccggaugcacgcucgucgagcauauugaaucacccagcaguauauggguguucgcuggcgccccugacagguguccacccacuugccuguuugugggugggauggcagagcuuggagccuucuuuucuauccugcaggauaugcggaacaccauuauggcuuccaaaacagucggcacugcggacgaaaaguugcgaaagaaaagcucguucuaccaaucuuaccuccgcagaacccaguccaugggcauccagcuggaucagaggauaauuguuauguuuaugguggcaugggggaaggaggccguagacaauuuccacuuaggagaugacauggacccugaacugcggucacucgcucaaauccuuaucgaucagaaagugaaggagauuaguaaccaggagccaaugaaacuguga

SEQ ID NO: 5870 - RNA, 1290 nt, Artificial Sequence
  derived and/or modified CDS sequence (opt3) from SEOV(CixiRf23)__FJ803201.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaaggacgcucgucgagcauaucgaaucccccucaagcauuuggguguucgccggcgcaccugaccggugcccacccacuugucuguuugugggugggauggccgagcuuggagcuuucuuuaguauacugcaggauaugcgaaacaccaucauggcgucuaaaacagucggcacugcagacgaaaaguugcgcaagaaauccagcuucuaccaaucguaccucagaaggacccagucuaugggcauucagcuggaucagcggaucauaguuauguuuaugguggccugggggaaggaggcuguagacaauuuccacuuaggagaugacauggacccugaacugcgcucccucgcccaaauucuuaucgaucagaaagugaaggagaucucaaaccaggagccaaugaaacuguga

SEQ ID NO: 5871 - RNA, 1290 nt, Artificial Sequence
  derived and/or modified CDS sequence (opt3) from SEOV(CixiRf56)__FJ803202.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggggagcuugucugguaacccagugaaucgggacuauauccgucagggccagggggcccuggcaggaauggaaccgaaagaguuucaagcucuacgccagcacgccaaggaugcuggcugcacgcucgucgagcauaucgaaucccccucaagcauuuggguguucgccggugcaccugacagauguccacccacuugccuguuugugggaggaauggccgagcuuggcgcuuucuuuaguauacugcaggauaugaggaacaccaucauggcgucuaaaacagucggcacugcagacgaaaaguugcggaagaaauccagcuucuaccaaucguaccuccgacgcacccagucuauggggauucagcuggaucagagaaucauaguuauguuuaugguggccuggggaaaggaggcuguagacaauuucccuuuagugcacgauauggacccaaaacugaggucccucucacaaauucuuaucgaccagaaggucaacgaaaucaguaaucaggagcccaugaaacuguga

SEQ ID NO: 5872 - RNA, 1290 nt, Artificial Sequence
  derived and/or modified CDS sequence (opt3) from SEOV(CixiRn21)__FJ803205.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacuccaaggaugccggaugcacgcucgucgagcauaucgaaucacccagcaguauuuggguguucgcuggcgccccugacagguguccacccacuugccuguuugugggugggauggaugagcuuggagcauucuuuucuauacugcaggacaugcggaacaccaucauggccuccaaaacagucggcacugcugaugaaaaguugcgaaagaaaagcucguucuaccaaucuuaccuccgcagaacccaguccaugggcauucagcuggaccacaggaucauaguuauguuuaugguggcgugggggaaggaggcaguagauaauuuccacuuaggagacgacauggauccugaacugcggacacucgcccagauucuuaucgaccaaaaagugaaggagaucucaaaccaggagccaaugaaacuguga

SEQ ID NO: 5873 - RNA, 1290 nt, Artificial Sequence
  derived and/or modified CDS sequence (opt3) from SEOV(CixiRn76)__FJ803206.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguucccaaaacgcccagucuagcaugaaagcggaggaaauaacuccaggacgcuuccgaacagcagugugcggccucuaccccgcccagauuaaggcuagaaauauggucuccccugugaugucaguaguuggcuuuuuagcccuggcaaaagauuggaccaguaggaucgaggaauggcuuggggcuccauguaaguucauggccgagagccccauugcgggaucuuuguccgguaacccugugaaucgggacuauauccgucagggccaaggggcccuggcaggaauggaaccaaaagaguuucaggcucuacgccagcacgccaaggaugcuggcugcacgcucgucgagcauaucgaaucaccgagcaguauuuggguguucgccggugcaagagacaggugucccccuacuugccuguuugucgggggaauggccgagcuuggcgcuuucuuuucuauacugcaagauaugcggaacaccaucauggcguccaaaacagugggcacugcagacgaaaaguugcgaaagaaaagcucguucuaccagucuuaccuccgcagaacccaguccauggggauucagcuggaucaaaggaucauaguuauguuuaugguggccuggggaaaggaggcuguagacaauuuccacuuaggugaugacauggacccagaacugcggucacucgcccagauucuuaucgaucagaaagugaaggagaucaguaaccaggagcccaugaaacuguga

SEQ ID NO: 5874 - RNA, 1290 nt, Artificial Sequence
  derived and/or modified CDS sequence (opt3) from SEOV(CUI)__GQ279395.1__N
auggccaccauggaggaacugcagagagagaucagcgcucacgaaggccaacucgugauugcaaggcagaaggucaaagacgccgagaagcaguacgaaaaagaucccgacgaucuuaacaagcgggcgcugcaugaccgcgaguccguugcugccucuauacagucaaaaaucgaugaguugaagcgacaauuagcagaccguauugccgcugggaagaauaucggacaggauagagacccuacagguguggaaccaggcgaucaccugaaagagaggagugcacuaagcuaugggaacacucucgaccuuaauucccuggauauugacgaaccgacgggacagaccgccgauuggcugacaaucauaguauacuugacuucuuucgugguccccaucauucucaaggcucuguauaugcugaccacacggggccgccagaccucgaaagacaacaaggguaugagaaucagguuuaaagacgauucaagcuacgaggacgugaaugggauucggaagccuaagcaucucuauguuaguaugccaaacgcccaauccucuaugaaagcggaggaaaucacucccggacgcuuccgaacagcagugugcggcuuauacccugcccagauaaaggcuagaaauaugcugagcccagucauguccgugguaggcuuucuugccuuggcaaaagauuggaccucaaggauugaggaauggcugggggcucccuguaaguucauggccgagaguccuaucgcgggaagccuaucugguaacccaguuaaucgggacuauauucgucagcgccagggcgcccucgcagggauggaaccgaaagaguuucaagcucugagacagcacuccaaggaugccggaugcacgcuuguggagcauaucgaaucacccagcaguaucugggucuucgcuggcgccccugacagguguccacccacuugccuguuugugggugggauggcagaguugggagccuucuuuucuauucuccaggauaugcggaacaccauaauggcuuccaaaacagugggcacugcggacaagaagcugcgcaaaaagagcucguucuaccaaucuuacuuacgaagaacccaguccaugggcauccagcuggaucagaggauuaucgucauguuuauguucgcaugggggaaagaagccguugacaauuuucaccucggagaugacauggacccugagcuucggggucuggcucaaauauugauugaucagaaggugaaagaaaucucaaaccaggagccaaugaagcuauga

SEQ ID NO: 5875 - RNA, 1290 nt, Artificial Sequence
  derived and/or modified CDS sequence (opt3) from SEOV(FeixianRn1)__GU592942.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauuacggguagcuugucuggaaacccagugaaucgggacuauauccgucagcgccagggcgcgcuggccgggauggaaccgaaagaguuucaagcacuaagacagcacgcuaaggaugccggaugcacucucgucgagcauaucgaaucccccucaagcauuuggguguucgcuggcgccccugacagguguccaccuaccugccuguuugugggugggauggcagagcuuggagccuucuuuaguauacugcaggauaugcggaacacaaucauggcuucuaaaacugucggcaccgcggacgaaaaguugcgaaagaaauccagcuucuaccaaucguaccuccgcagaacacagucuaugggcauucagcuggaucagaggaucauaguuauguuuaugguggcaugggggaaggaggccguagacaauuuccacuuaggagaugacauggaccccgaacugcggucccucgcucaaauucuuaucgaucagaaagugaaggagaucucaaaccaggagccaaugaaacuguga

SEQ ID NO: 5876 - RNA, 1290 nt, Artificial Sequence
  derived and/or modified CDS sequence (opt3) from SEOV(GanyuRn66)__GU592932.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucacggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacucucgucgagcauaucgaaucccccucaagcauuuggguguucgccggcgcaccugacagguguccaccuaccugccuguuugugggugggauggccgagcuuggagcuuucuuuaguauacugcaggauaugcggaacacaaucauggcgucuaaaacugucggcaccgcagacgaaaaguugcgaaagaaauccagcuucuaccaaucguaccuccgcagaacacagucuaugggcauucagcuggaucagaggaucauaguuauguuuaugguggccugggggaaggaggcuguagacaauuuccacuuaggagaugacauggaccccgaacugcggucccucgcccaaauucuuaucgaucagaaagugaaggagaucucaaaccaggagccaaugaaacuguga

SEQ ID NO: 5877 - RNA, 1290 nt, Artificial Sequence
  derived and/or modified CDS sequence (opt3) from SEOV(Gongzhuling108)__KF745947.1__N
auggccaccauggaggaaauccagagagagauuagcgcucacgaaggccaacuggugauagcaaggcagaaggucaaagacgccgagaagcaguacgaaaaagaucccgacgaucucaacaaguccgcgcuucaugaccgggagucuguugcugccucaauccagaguaaaauugaugagcugaagcgccaauuggcagaccgaaucgccgcugggaagaauauuggacaggaucgugacccuacagguguggaaccaggcgaucacuuaaaagagagaagcgcacuguccuaugggaacacucuagaccucaauucucuggauaucgacgaaccgacgggacagaccgccgauuggcuuacaauacugguauacuugacuucguucgugguccccaucauucucaaggcucuguauaugcugaccacaaggggccggcagaccucaaaagacaacaaggguaugcgcaucagauuuaaagacgaugggagcuacgaggacgugaauggaauuaggaagccuaagcaucucuauguuccaaugcccaacgcccaaaguuccaugaaagcggaggaaaucacuccuggccgguuccgcacagcagugugcggcuuauacccagcccagauaaagccccgaaauauggucucuccugugaugagcguaguuggguuucuggcucuugccaaagauuggaccuccagaauugaggaaugguugggagcaccauguaaguucauggcugagucaccgaucgccgguagucugagcggcaaccccgugaauagggacuauauucggcagcgucagggggcgcuagccggaauggaaccuaaagaguuucaagcacuccgccagcacgcuaaggaugccggcugcacgcuggucgagcauaucgaaucuccauccucaaucagaguguucgcuggugcccccgcaagguguccuccaacuugccuuuuugucgggggaauggccgagcugggcgcuuucuuuagcauuuugcaggacaugcggaacaccauaauggcgaguaaaacagugggcacugcagaugaaaagcuccgaaagaaaucuuccuucuaccaaagcuaccugcgcagaucgcagucuauggggauccaguuagaccagaggauuaucguuauguuuaugguggccuccggaaaggaggcuguagauaauuuccaccugggugacgauauggaccccgaacuccggucacuugugcaaauacugauugaccagaaagucaaggagaucaguaaccaggagccgaugaaauuguga

SEQ ID NO: 5878 - RNA, 1290 nt, Artificial Sequence
  derived and/or modified CDS sequence (opt3) from SEOV(Gongzhuling147)__KF745948.1__N
auggccaccauggaggaaauccagagagagauuagcgcucacgaaggccaacuggugauagcaaggcagaucgucaaggacgccgagaaacaguacgaaaaggaucccgcggaccucaacaaacgggcccuucaugaucgcgaguccguugcugcaucuauucagucaaagaucgacgagcugaaacgacacuuggccgaucguauugcugcagggaagaauaucggacaagacagagauccuacagguguggaaccaggcgaccauuuaaaggagaggagugcccugagcuaugggaacacucuagaucucaauucccuggacauagaugaaccgacgggacagaccgcugacuggcuuacaaucauuguauaccugacuucuuucgugguccccaucauuuugaaagcccucuauauccugaccacaucgggccggcagaccucaaaggauaacaaagguaugcgcauaagauuuaaggacgacagcaguuacgaggaugugaaugggauuaggaugccuaaacaccuguauguuccaaugcccaacgcgcaguccucuaugaaggcagaggacaucacuccuggacgguuccgcacagccgugugcggccucuacccagcucaaauuaaggcccgaaauauggucagccccuuaauguccgugguaggcuuucuggcacuuccuaaagauuggaccucaagaaucgacgaaugguugggggcuccauguaaguucauggccgagaguccgaucgcgggaagccugucugguaaccccguuaauagggaucauauucggcagcgucagggcgcccuagcagggauggacccuaaagaauuucaggcugugcgccaacacgccaaggaugcuggaugcacgcucgucgagcacauagaauccccaucaagcaucuggguguucgccggcgcacccgacagauguccuccaacuugccuguuugugggugggauggccgagcuuggagcuuucuuuaccauucugcaggauaugaggaacacaaucaugcccaguaaaacugucggcaccgcggacgagaaguugcggaaaaagucuuccuucuaucagagcuaccuccgacgcacacaaucgaugggcauacagcuggaucagagaauuaucguuaucuuuaugguggcaugggccaaggaagcuguagacaauuuccauuuaggggacgauauggacccggagcugaggucucucgcccagauucuuaucgaucaaaaagugaaggaaauuuccaaccaggucccuaugaaacuguga

SEQ ID NO: 5879 - RNA, 1290 nt, Artificial Sequence
  derived and/or modified CDS sequence (opt3) from SEOV(Gongzhuling415)__KF745949.1__N
auggccaccauggaggaaauccagagagagauuagcgcucacgaaggccaacuggugauagcaaggcagauggucaaggacgccgagaaacaguacgaaaaggaucucgcggaccuuaacaaacgggcucugcaugaucgcgaguccguugccgcaucuauccagucaaagauugacgaguugaaacgacaauuagccgaucguaucgcugcagggaagaauauugaacaggacagagaucccacaggaguggagccuggugaccaccugaaggaaaggagugcccuaagcuauggcaacacucucgaucuuaauucccuggacaucgaugagccaacggggcagaccgcugacuggcugacaauaaucguauacuugacuucuuucguggucccgauuauccucaaagcccuguauauucugaccacacggggacgccagaccucgaaggauaacaaaggcaugacuaucagauuuaaggacgacucaagcuacgaggaugugaaugguauaaggaugcccaaacaucucuauguuccuaugccaaacgcgcaaaguuccaugaaggcagaagacauuacacccgggcgguuccgcaccgccgugugcggauuauacccugcucagaucaaggcccgaaauauggucucuccacugaugagcgugguaggcuuucuugcauugcccaaagauuggacguccagaauugacgaguggcugggcgcuccuuguaaguucauggccgaaucaccaaucgcggggagucuaagcggaaacccgguuaauagggaucacauccggcagcgucagggugcccucgcaggcauggaccccaaagaguuucaagcugugcgccagcaugccaaggaugcugggugcacucuggucgaacacauugagucuccuuccucaauauggguguucgccggagcaccagacagaugucuuccuaccugccuguuugugggcgguauggccgaguugggggcuuucuuuacaauccuccaggauaugaggaacacuauuauggcgagcaaaaccgucggaacagcagacgaaaagcugggcaaaaagaguucuuucuaucaauccuacuuacggcgaacccagagcaugggcauccagcuggaucagcgcauaauuguuauguuuaugguggccugggcuaaggaggccguagacaauauccaccucggggacgauauggaccccgaacuuagaucgcuggcacaaaucuugauugaucagaaagugaaggagaucucuaaccaggucccaaugaaacuauga

SEQ ID NO: 5880 - RNA, 1290 nt, Artificial Sequence
  derived and/or modified CDS sequence (opt3) from SEOV(Gongzhuling42)__KF745942.1__N
auggccaccauggaggaaauccagagagagauuagcgcucacgaaggccaacuggugauagcaaggcagaaggucaaagacgcccagaagcaguacgagaaagaucccgacgaucucaacaagcgggcgcuucaugaccgcgaauccguugcugccucuauccaacugaaaauugaugaguugaagcgacaguuagcagaccguaucgccgcugggaagaauauuggacaggauagagacccuacagguguggagccaggcgaucaccugaaagaaaggucagcacuaaguuaugggaacacucucgaccugaauagccuugauaucgacgagccgacgggacagaccgccgauuggcugacaauaaucguauacuugacuuccuucgugguccccauuauccucaaggcucuguauaugcugaccacacggggccgccaaaccucuaaagacaacaaggguaugagaauuagguuuaaagacgauucgucauacgaagacgugaaggggauccggaagccuaaacaucucuauguuccaaugcccaaugcccagagcaguaugaaggcggaggagauaacuccuggacgcugccgaacagcaguguguggcuuauacccagcccagauuaaagcuagaaacauggucucccccgugaugucugccguaggcauccuggcacuugcuaaggauuggaccagcaggauugaagagugguuggggacgccuugcaaauucauggccgaauccccaaucgcgggaucacugagugguaauccgguuaaccgggaccacauccgucagcgccaaggcgcccuagcagggauggagcccaaggaauuucagggacucagacagcaugcuaaagaugccggcuguacucugguggagcacauugagagcccuucuuccauaugggucuucgcuggugccccagacaggugucccccuaccugccuuuuugucgggggaauggcagaacugggcgccuucuuugcuaucuugcaagauaugcggaauacaauuauggcgucaaagacugugggcaccgcagacgagaagcuccgcaaaaagagcaguuucuaucagucuuaccugcgaagaacacaguccauggggauccaguuagaucaaaggauaauugugauguuuaugguugccugggcuaaagaagccguggacaacuuccaccugggagaugacauggacccagagcuccggagccuugcacagauccugauggaucagaagguaaaagaaaucucgaaucaggagcccaugaaguuguga

SEQ ID NO: 5881 - RNA, 1290 nt, Artificial Sequence
  derived and/or modified CDS sequence (opt3) from SEOV(Gongzhuling45)__KF745943.1__N
auggccaccauggaggaaauccagagagagauuagcgcucacgaaggccaacuggugauagcaaggcagauggucaaggacgccgagaaacaguacgaaaaggaucccgcggaccucaacaaacgggcccuucaugaucgcgaguccguugcugcaucuauccagucaaagauugacgagcugaaacgacaauuggccgaucguaucgcugcagggaagaauauuggacaggacagagauccuacagguguggaaccaggcgaccacuuaaaggagaggagugcccugagcuaucggaacacucuagaucucaauucccuggacaucgaugaaccgacggggcagaccgcugacuggcuuacaauaaucguauaccugacuucuuucgugguccccauuaucuugaaagcccucuauauucugaccacacgcggaagacagaccucgaaggauaacaaaggcaugaggauccgguuuaaggacgacucaagcuacgaggaugugaaugguauacgcaugccuaaacaucuguaucucccaaugcccaacgcgcaaaguuccaugaaggcagaggacauuacuccugggcgauucagaacagccguuugcggauuauacccagcucagaucaaggccaggaauauggugucuccccugaugagcgucgugggcuuucuugcauugccuaaagauuggaccucccggauugacgaauggcugggcgcuccauguaaguucauggccgagucaccgaucgcggggagucuaagcggaaaccccguaaaucgugaucacauccgccagagacagggugcccucgcaggcauggacccuaaagaauuucaagcuguuaggcagcaugccaaggaugcugggugcacgcugguggagcacauugaaucuccauccucaauaugggucuucgccggagcacccgaccgguguccuccaacuugccuuuuugugggcgguauggccgagcugggggcuuucuuuaccaucuugcaggauaugcgaaacacaauuauggcgagcaaaacugugggaaccgcagacgagaagcuccgcaaaaagaguucuuucuaucaauccuaccugagaaggacacagagcaugggcauccaguuagaucagcggauaauugucauguuuaugguugccugggcuaaggaagccguggacaauuuccaccugggcgacgauauggaccccgagcuccgcucgcuugcacaaauccugaucgaucauaaaguaaaggaaauuucuaaccaggugccgaugaaauuguga

SEQ ID NO: 5882 - RNA, 1290 nt, Artificial Sequence
  derived and/or modified CDS sequence (opt3) from SEOV(Gongzhuling58)__KF745944.1__N
auggccaccauggaggaaauccagagagagauuagcgcucacgaaggccaacuggugauagcaaggcagauggucaaggacgccgagaaacaguacgaaaaggaucccgcggaccucaacaaacgggcccuucaugaucgcgaguccguugcugcaucuauccagucaaagauugacgagcugaaacgacaauuggccgaucguaucgcugcagggaagaauauuggacaggacagagauccuacagguguggaaccaggcgaccacuuaaaggagaggagugcccugagcuaugggaacacucuagaucucaauucccuggacaucgaugaaccgacgggacagaccgcugacuggcuuacaauaaucguauaccugacuucuuucgugguccccauuaucuugaaagcccucuauauucugaccacacggggccgccagaccucgaaggauaacaaagguaugagaaucagguuuaaggacgacucaagcuacgaggaugugaaugggauacggaugccuaaacaucuguauguuccaaugcccaacgcgcaaaguuccaugaaggcagaggacauuacuccuggacgcuuccgaacagccgugugcggccucuacccagcucagaucaaggccagaaauauggucucucccuuaaugagcgugguaggcuuucuggcacuuccuaaagauuggaccuccaggauugacgaaugguugggggcuccauguaaguucauggccgagucaccgaucgcgggaagucugagcgguaaccccguuaaucgggaucacauccgucagcgccagggcgcccuagcagggauggacccuaaagaauuucaagcugugagacagcaugccaaggaugcuggaugcacgcucgucgagcacauugaaucuccauccucaauauggguguucgccggcgcacccgacagguguccuccaacuugccuguuugugggugggauggccgagcuuggagcuuucuuuaccauccugcaggauaugcggaacacaauuauggcgagcaaaacugucggcaccgcagacgagaaguugcgcaaaaagaguucuuucuaucaauccuaccuccgaagaacacagagcaugggcauccagcuggaucagaggauaauuguuauguuuaugguggccugggcuaaggaagccguagacaauuuccacuuaggggacgauauggaccccgagcugcggucgcucgcacaaauccuuaucgaucagaaagugaaggaaauuucuaaccaggucccgaugaaacuguga

SEQ ID NO: 5883 - RNA, 1290 nt, Artificial Sequence
  derived and/or modified CDS sequence (opt3) from SEOV(Gongzhuling85)__KF745945.1__N
auggccaccauggaggaaauccagagagagauuagcgcucacgaaggccaacuggugauagcaaggcagauggucaaggacgccgagaaacaguacgaaaaggaucccgcggaccucaucaaacgggcccuucaugaucgcgaguccguugcugcaucuauucagucaaagaucgacgagcugaaacgacaauuggccgaucguauugcugcagggaagaacaucggacaggacagagauccuacagguuuagaaccaggcgaccaccugaaggagaggagugcccuaagcuaugggaauacucucgaucugaacucccuugacauagaugaaccgacgggacagaccgcugacuggcugacagugaucguauacuugacuucuuucgugguccccauuauccucaaagcccuguauauucugaccacacggggccgccagaccucgaaggauaauaaagguaugagaaucagguuuaaggacgugucaagcuacgaggacguuaacgggauacggaugccuaaacaucucuaugugccaaugcccaaugcgcaaaguuccaugaaggcagaggauauuacuccuggacgcuuccgaacagccgucugcggcuuauacccagcucagaucaaggccagaaacauggugucuccccugaugagcguaguuggcuuucuugcauugccuaaagacuggaccuccaggauugaugaauggcugggggcuccauguaaguucauggccgagucaccgaucgcgggaagucuaagcgguaaucccgugaaccgggaccacauccgucagcgccagggcgcccucgcagggauggauccuaaagaauuucaagcugucagacagcaugccaaggacgcuggaugcacgcugguggagcacauugaaucuccauccucaauauggguguucgccggcgcacccgauagguguccuccaacuugccuuuuuguccgggguauggccgagcugggggcuuucuuuaccaucuugcaggacaugcgaaauacaauuauggcgagcaaaacuguuggaaccgcagaugagaagcuccgcaaaaagaguucuuucuaucaauccuaccugagaaggacacagagcaugggcauccaguuagaccagcggauaauugugauguuuaugguagccugggcuaaggaagccguggauaacuuccaccugggcgacgacaugcaucccgagcuccgcucgcuugcacaaauccugaucgaucagaaagucaaggaaauuucuaaucaggugccgaugaaauuguga

SEQ ID NO: 5884 - RNA, 1290 nt, Artificial Sequence
  derived and/or modified CDS sequence (opt3) from SEOV(Gongzhuling97)__KF745946.1__N
auggccaccauggaggaaauccagagagagauuagcgcucacgaaggccaacuggugauagcaaggcagauggucaaggacgccgagaaacaguacgaaaaggaucccgcggaccucaacaaacgggcccuucaugaucgcgaguccguugcugcaucuauccagucaaagauugacgaucugaaacgacaauuggccgaccguaucgcugcagggaagaauauuggacaggauagagacccuacagguguggagccaggcgaucacuuaaaggaaaggagugcccugagcuaugggaacacucuagaccucaauucccuggauaucgacgagccgacgggacagaccgcugauuggcuuacaauaaucguauaccugacuucuuucgugguccccauuaucuugaaagcccucuauaugcugaccacacggggccgccagaccucgaaggacaacaaagguaugagaauuagguuuaaggacgauucaagcuacgaagacgugaaugggauccggaugccuaaacaucuguauguucgcaugccaaacgcgcaaaguuccaugaaggcagaggauauaacucccggacgauucagaacagccgugugcggccucuacccugcucagauuaaggccaggaauauggucucuccauuaaugagcgugguaggcuuucuggcacuucccaaagacuggaccucccggaucgaugagugguugggggcuccuuguaaguucauggccgaaucaccaauugcgggaagucugagcgguaacccgguuaaucgugaccacauccgccagagacagggcgcccuagcagggauggaucccaaagaguuucaagcugugaggcagcaugccaaggacgcuggaugcacgcucgucgaacacaucgagucuccuuccucaauuuggguguucgccggcgcaccagaucggugucccccuacuugccuguuugugggugggauggccgaacuuggagcuuucuuuaccauacugcaggacaugcgaaucacaauuauggcgagcaaaacugucggcaccgcagaugagaaguugcgcaaaaagaguucuuucuaucaauccuaccucagaaggacacagagcaugggcauccagcuggaccagcgguuaauaguuauguuuaugguggccugggcuaaggaggccguagacaacuuccaccugggggaugacauggauccagaacuccgcucgcuugcacaaauucugaucgaccagaaagugaagcagaucucuaaucagguccccaugaaauuguga

SEQ ID NO: 5885 - RNA, 1290 nt, Artificial Sequence
  derived and/or modified CDS sequence (opt3) from SEOV(Gou3)__AB027522.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggcagcuuccgcacagcagugugcggacucuacccugccaccauuaaggcucgaaauauggucuccccagugaugucaguaguuggcuuuuuagcccuggcaaaagauuggacgaguagaaucgaggacuggcuuggggcucccuguaaguucauggccgaaagcccuauugcgggaucuuuguccgguaacccagugaauagggauuauauccggcagcgucagggcgcccuggcagggauggagccgaaagaauuucaggcucuacgccaacacucaaaggacgccggaugcacuauggucgagcagaucgagagccccaguucuauuuggguguucgcuggcgccccugauagauguccaccuaccugccucuuugugggugggauggcagaacugggagccuucuuuuccauacuucaggacaugaggaacacaaucauggcuagcaaaacugucggcaccgcggaugagaagcugcggaagaaaucgucuuucuaccaauccuacuugcgacgcacacagucaaugggcauucagcucgaccagagaaucauaguuauguuuaugguggcaugggggaaggaagccguagauaauuuccaucugggagacgacauggaucccgaguuaaggagucuggcucaaauucucaucgaccagaaagugaaggaaaucagcaaccaggagccaaugaaacuuuga

SEQ ID NO: 5886 - RNA, 1290 nt, Artificial Sequence
  derived and/or modified CDS sequence (opt3) from SEOV(Hb8610)__AF288643.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaguauuggacaggauagagacccuacagguguggaaccaggcgaucacuuaaaagagaggagcgcacuguccuaugggaauacucuagaccucaacucucuggauaucgacgaaccgacgggacagaccgccgauuggcuuacaauaaucguauaccugacuucguucgugguccccauuaucuugaaggcucucuauaugcugaccacacggggccgccagaccucaaaagacaauaaggguaugagaauuagguuuaaagacgauagcaguuacgaggacgugaacgggauccggaagccuaagcaucuguauguuuccaugccaaaugcccaaucuagcaugaaagcggaggaaauaacucccggacgcuuccgaacagcagugugcggccucuacccugcccagauuaaggcuagaaacauggucuccccagugaugucaguaguuggcuuuuuagcccuggcaaaagauuggaccaguaggaucgaggaauggcuuggggcucccuguaaguucauggccgagagcccuauugcgggaucuuuguccgguaauccagugaaccgggacuauauccgucagcgccagggcgcccuggcagggauggaaccgaaagaguuucaagcucuaagacagcacgccaaggaugcuggaugcacgcucgucgagcauaucgaaucacccagcaguauuuggguguucgccggcgcaccugacagguguccacccacuugccuguuugugggugggauggccgagcuuggagcuuucuuuucuauacugcaggauaugcggaauaccaucauggcguccaaaacagucggcacugcagacgaaaaguugcgaaagaaaagcucguucuaccaaucuuaccuccgcagaacccaguccaugggcauucagcuggaucagaggaucauaguuauguuuaugguggccugggggaagaaagcuguagacaacuuccacuuaggagaugacauggacccugagcugcggucacucgcccaaauucuuaucgaucagaaggugaaagaaaucaguaaucaggagccaaugaagcuguga

SEQ ID NO: 5887 - RNA, 1290 nt, Artificial Sequence
  derived and/or modified CDS sequence (opt3) from SEOV(HuBJ16)__GQ279380.1__N
auggccaccauggaggaaauccagagagagauuagcgcucacgaaggccaacuggugauagcaaggcagaaggucaaaaacgccgagaagcaguacgaaaaagaccccgaugaccucaauaagcgggcgcuucaugaucgcgaguccguugcugccucuauccagucaaaaauugacgagcugaagcgacaauuggcagaucguaucgccgcugggaagaacauuggacaggacagagauccuacagguguggaaccaggcgaccacuuaaaagagaggagugcacugagcuaugggaauacucuagaucucaacucccuggacaucgaugaaccgacgggacagaccgccgacuggcuuacaauaaucguauaccugacuucuuucgugguccccauuaucuugaaggcucucuauaugcugaccacacggggccgccagaccucgaaagauaauaaggguaugagaauuagguuuaaagacgacucaagcuacgaggaugugaacgggauccggaagccuaagcaucuguauguuaguaugccaaaugcccaauccucuaugaaagcggaggaaauaacucccggacgcuuccgaacagcagugugcggccucuacccugcccagauuaaggcuagaaacauggucagcccagugauguccguaguuggcuuuuuagcccuggcaaaagacuggaccucaaggaucgaggaauggcuuggggcucccuguaaguucauggccgagaguccuauugcggguagcuugucuggaacgccagugaaucgggauuauauccgucagcgccagggcgcccuggcagggauggaaccgaaagaguuucaagcucuaagacagcacgccaaggacgcuggaugcacucucgucgagcauaucgaaucccccucaagcauuuggguguucgccggcgcaccugauagguguccaccuaccugccuguuugugggugggauggccgagcuuggagcuuucuuuaguauacugcaggacaugcggaacacaaucauggcgucuaaaacugucggcaccgcagaugaaaaguugcgaaagaaauccagcuucuaccaaucguaccuccgcagaacacagucuaugggcauucagcuggaccagaggaucauaguuauguuuaugguggccugggggaaggaggcuguagauaauuuccacuuaggagacgauauggaccccgaacugcggucccucgcccaaauucuuaucgaccagaaagugaaggagaucucaaaccaggagccaaugaaacuguga

SEQ ID NO: 5888 - RNA, 1290 nt, Artificial Sequence
  derived and/or modified CDS sequence (opt3) from SEOV(HuBJ22)__GQ279379.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaacgccagugaaccgggacuauauccgucagcgccagggcgcccuggcagggauggaaccgaaagaguuucaagcucuaagacagcacgccaaggaugcuggaugcacucucgucgagcauaucgaaucccccucaagcauuuggguguucgccggcgcaccugacagguguccaccuaccugccuguuugugggugggauggccgagcuuggagcuuucuuuaguauacugcaggauaugcggaauacaaucauggcgucuaaaacugucggcaccgcagacgaaaaguugcgaaagaaauccagcuucuaccaaucguaccuccgcagaacacagucuaugggcauucagcuggaucagaggaucauaguuauguuuaugguggccugggggaaggaggcuguagacaacuuccacuuaggagaugacauggaccccgaacugcggucccucgcccaaauucuuaucgaucagaaagugaaggagaucucaaaucaggagccaaugaaacuguga

SEQ ID NO: 5889 - RNA, 1290 nt, Artificial Sequence
  derived and/or modified CDS sequence (opt3) from SEOV(HuBJ3)__GQ279391.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagugaacaaggguaugagaauuagguuuaaagacgacucaagcuacgaggauguuaaugggauccggaagccuaagcaucuguaugugaguaugccaaacgcccaauccucuaugaaagcggaggaaauaacucccggacgcuuccgaacagcagucugcggccucuacccugcccagauuaaggcuagaaauauggugagcccaguaauguccguugugggcuuuuuagcccuggcaaaagacuggaccucaaggaucgaggaauggcuuggggcucccugucgguucauggccgagaguccuauugcggguagcuugucuggaaacccagucaaucgugauuauauccgccagagacagggcgcccuggcagggauggaaccgaaggaguuucaagcucuaaggcagcacgccaaagacgcuggaugcacgcucguggagcauaucgaaucccccucaagcauuuggguguucgccggcgcaccugaggguuguccacccacuugccuguuugucgggggaauggccgaacuuggcgcuuucuuuaguauacugcaggauaugcggaacaccaucauggcgucuaagacaguuggcacugcagacgagaaauugcgaaagaaguccagcuucuaccaaucguaccuccgcagaacccagucuauggggauucagcuggaucagaggaucauagugauguuuaugguagccuggggaaaagaagcuguggacaauuuccacuuaggugaugacauggauccugagcugcggucccucgcccaaauucuuaucgaccagaaggucaaagagaucucaaaccaggaaccaaugaagcuguga

SEQ ID NO: 5890 - RNA, 1290 nt, Artificial Sequence
  derived and/or modified CDS sequence (opt3) from SEOV(K24-e7)__AF288653.1__N
auggccaccauggaggaaauccagagagagauuagcgcucacgaaggccaacuggugauagcaaggcagaaggucaaagacgccgagaagcaguacgaaaaagaucccgacgauuucaacaagcgggcgcuccaugaccgcgaguccguugcugccucuauccagucaaaaauugaugagcuuaagcgacaacuggcagaccguaucgccgcugggaagaauauuggacaggauagagacccuacagguguggaaccaggcgaucacuugaaagagaggagugcauuaagcuaugggaacacucuggaccuaaauucccucgauaucgacgaaccgacgggacagaccgccgauuggcugacaauaaucguauaccuuacuucuuuugugguccccauuauccugaaggcuuuguauaugcucaccacacggggccgccagaccucgaaagacaacaaggguaugagaauuagguucaaagacgauucaagcuacgaggacgugaaugggauccggaagccuaagcaucuguauguuaguaugccaaacgcccaauccucuaugaaagcggaggaaauaacucccggacgcuuucgaacagcagugugcggccuguacccugcccagauuaaggcuagaaauauggucagcccagugauguccguaguuggcuuccucgccuuagcaaaagauuggaccucaaggaucgaggaauggcugggggcucccuguaaguuuauggccgagaguccuauugcgggaagccuuucugguaacccagugaaucgggacuauauccgucagcgccagggcgccuuggcagggauggaaccgaaagaguuccaagcucugagacagcacgccaaggaugcuggaugcacgcuagucgagcauaucgaaucccccucaagcauuuggguguuugccggcgcaccugacagguguccacccacuugccucuucgugggugggauggccgagcugggagcguuuuucaguauacuucaggauaugcggaacaccaucauggcuucuaaaacagucggcacugcagacgaaaagcugcgaaagaaauccagcuuuuaccaaucguacuugcgcagaacccagucuaugggcauucagcucgaucagaggaucauaguuauguucaugguggccugggggaaggaggcuguagacaauuuucaccugggagaugacauggacccugaauuacggucccuggcccaaauucucaucgaucagaaagugaaggagaucucaaaccaggagccaaugaaacuuuga

SEQ ID NO: 5891 - RNA, 1290 nt, Artificial Sequence
  derived and/or modified CDS sequence (opt3) from SEOV(K24-v2)__AF288655.1__N
auggccaccauggaggaaauccagagagagauuagcgcucacgaaggccaacuggugauagcaaggcagaaggucaaagacgccgagaagcaguacgaaaaagaucccgacgauuucaacaagcgggcgcuccaugaccgcgaguccguugcugccucuauccagucaaaaauugaugagcuuaagcgacaacuggcagaccguaucgccgcugggaagaauauuggacaggauagagacccuacagguguggaaccaggcgaucacuugaaagagaggagugcauuaagcuaugggaacacucuggaccuaaauucccucgauaucgacgaaccgacgggacagaccgccgauuggcugacaauaaucguauaccuuacuucuuuugugguccccauuauccugaaggcuuuguauaugcucaccacacggggccgccagaccucgaaagacaacaaggguaugagaauuagguucaaagacgauucaagcuacgaggacgugaaugggauccggaagccuaagcaucuguauguuaguaugccaaacgcccaauccucuaugaaagcggaggaaauaacucccggacgcuuucgaacagcagugugcggccuguacccugcccagauuaaggcuagaaauauggucagcccagugauguccguaguuggcuuccucgccuuagcaaaagauuggaccucaaggaucgaggaauggcugggggcucccuguaaguuuauggccgagaguccuauugcgggaagccuuucugguaacccagugaaucgggacuauauccgucagcgccagggcgccuuggcagggauggaaccgaaagaguuccaagcucugagacagcacgccaaggaugcuggaugcacgcuagucgagcauaucgaaucccccucaagcauuuggguguuugccggcgcaccugacagguguccacccacuugccucuucgugggugggauggccgagcugggagcguuuuucaguauacuucaggauaugcggaacaccaucauggcuucuaaaacagucggcacugcagacgaaaagcugcgaaagaaauccagcuuuuaccaaucguacuugcgccacacccagucuaugggcauucagcucgaucagagaaucauaguuauguucaugguggccugggggaaggaggcuguagacaauuuucaccugggagaugacauggacccugaauuaaggucccuggcccaaauucucaucgaucagaaagugaaggagaucucaaaccaggagccaaugaaacuuuga

SEQ ID NO: 5892 - RNA, 1290 nt, Artificial Sequence
  derived and/or modified CDS sequence (opt3) from SEOV(OuhaiRf35)__FJ803208.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacgcucgucgagcauaucgaaucccccucaagcauuuggguguucgccggcgcaagggaccgguguccuccaacuugccuguuugugggugggauggccgagcuuggagcuuucuuuaguauacugcaggauaugcgaaacaccaucauggcgucuaaaacagucggcacugcagacgaaaaguugcgcaagaaauccagcuucuaccaaucguaccucagaaggacccagucuaugggcauucagcuggaucagcggaucauaguuauguuuaugguggccugggggaaggaggcuguagacaauuuccacuuaggagaugacauggaccccgaacugcgcucccucgcccaaauucuuaucgaucagaaagugaaggagaucucaaaccaggagccuaugaaacuguga

SEQ ID NO: 5893 - RNA, 1290 nt, Artificial Sequence
  derived and/or modified CDS sequence (opt3) from SEOV(OuhaiRn146)__FJ803210.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggggagcuugucugguaacccagugaaucgggacuauauccgucagggccagggggcccuggcaggaauggaaccgaaagaguuucaagcucuacgccagcacgccaaggaugcuggcugcacgcucgucgagcauaucgaaucccccucaagcauuuggguguucgccggugcaagagacagguguccuccaacuugccuguuugugggaggaauggccgagcuuggcgcuuucuuuaguauacugcaggauaugcggaacaccaucauggcgucuaaaacagucggcacugcagacgaaaaguugcgaaagaaauccagcuucuaccaaucguaccuccgcagaacccagucuauggggauucagcuggaucagaggaucauaguuauguuuaugguggccuggggaaaggaggcuguagacaauuuccacuuaggugaugacauggaccccgaacugcggucccucgcccaaauucuuaucgaucagaaagugaaggagaucucaaaccaggagccuaugaaacuguga

SEQ ID NO: 5894 - RNA, 1290 nt, Artificial Sequence
  derived and/or modified CDS sequence (opt3) from SEOV(Pf26)__AY006465.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucugugcagucaaaaaucgaugagcugaagcgacaauuggcagaccguauugccgcugggaagaauaucggacaggauagagacccuacagguguagaaccaggcgaucacuuaaaagagaggagugcacugagcuaugggaacacucuagaccucaauucccuggauauugacgaaccgacgggacagaccgccgauuggcuuacaaucauaguguaccugacuucuuucgucgugcccaucauuuugaaggcucucuauaugcugaccacacggggccgccagaccucgaaagacaacaaggguaugagaaucagguuuaaagacgauucaagcuacgaggacguuaaugggauucggaagccuaagcaucuguaugugaguaugccaaacgcccaauccucuaugaaagcggaggaaaucacucccggacgcuuccgaacagcagucugcggccucuacccugcccagauaaagccaagaaauauggugagccccguaauuuccguugugggcuuuuuagcucuggccaaagauuggaccucaaggaucgaggaauggcuuggggcaccuuguaaguucauggcugagaguccaauugccgguagcuugucuggaaacccggucaaucgggacuauauccgucagcgccagggcgcgcuggccgggauggaacccaaagaguuucaagcacuaagacagcacgcuaaggaugccggaugcacgcucguggagcauaucgaauccccuucaagcauuuggguguucgcuggcgccccagacaggugucccccuacuugccuguuugucggugggauggcagagcuuggagccuucuuuaguauacugcaggauaugcggaacaccaucauggcuucuaaaacaguuggcacugcggacgaaaaguugcgaaagaaauccagcuucuaccaaucguaccuccgcagaacccagucuaugggcauucagcuggaucagaggaucauagugauguuuaugguagcaugggggaaggaggccguggacaauuuccacuuaggagaugacauggacccagaacugcggucccucgcucaaauucuuaucgaucagaaagucaaggagaucucaaaccaggagcccaugaaacuguga

SEQ ID NO: 5895 - RNA, 1290 nt, Artificial Sequence
  derived and/or modified CDS sequence (opt3) from SEOV(Rn-CP7)__GQ279382.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaagcauggucuccccagugaugucaguaguuggcuuuuuagcccuggcaaaagauuggaccaguaggaucgaggaauggcuuggggcucccuguaaguucauggccgagagcccuauugcgggaucuuuguccgguaauccagugaaccgggacuauauccgucagcgccagggcgcccuggcagggauggaaccgaaagaguuucaagcucuaagacagcacgccaaggaugcuggaugcacgcucgucgagcauaucgaaucacccagcaguauuuggguguucgccggcgcaccugacagguguccacccacuugccuguuugugggugggauggccgagcuuggagcuuucuuuucuauacugcaggauaugcggaauaccaucauggcguccaaaacagucggcacugcagacgaaaaguugcgaaagaaaagcucguucuaccaaucuuaccuccgcagaacccaguccaugggcauucagcuggaucagaggaucauaguuauguuuaugguggccugggggaaggaggcuguagacaacuuccacuuaggagaugacauggacccugaacugcggucacucgcccaaauucuuaucgaucagaaagugaaggagaucaguaaucaggagccaaugaaacuguga

SEQ ID NO: 5896 - RNA, 1290 nt, Artificial Sequence
  derived and/or modified CDS sequence (opt3) from SEOV(Rn-DC8)__GQ279386.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccgcccggggccgccagacaucgaaagacaacaaggguaugagaauuagguuuaaagacgauucaagcuacgaggacgugaaugggauccggaagccuaagcaucuguauguuaguaugccaaacgcgcaauccucuaugaaagcagaggaaauaacccccggacgcuuccgaacugccgugugcggccucuacccugcucagauuaaggccagaagcauggucuccccagugaugucaguaguuggcuuuuuagcacuggcuaaagauuggacaaguaggaucgaggaauggcuuggggcccccuguaaguucauggcggagagcccuauugccggaucuuuguccgguaauccagugaaccgggacuauauccgucagcgccagggcgcacuggcugggauggaaccgaaagaguuucaagcccuaagacagcacgcuaaggaugccggaugcacccucgucgagcauaucgaaucacccagcaguauuuggguguucgcaggcgccccugacagguguccacccacgugccuguuugugggugggauggcugagcuuggagcguucuuuucuauacugcaggauaugcggaauacuaucauggcauccaaaaccgucggcacagccgacgaaaaguugcgaaagaaaagcucguucuaccaaucuuaccuccgcagaacucaguccaugggcauucagcuggaucagaggaucauaguuauguuuaugguggcuugggggaaggaggccguagacaacuuccacuuaggagaugacauggacccugaacugcggucacucgcacaaauucuuaucgaucagaaagugaaggagaucaguaaucaggagccaaugaaacuguga

SEQ ID NO: 5897 - RNA, 1290 nt, Artificial Sequence
  derived and/or modified CDS sequence (opt3) from SEOV(Rn-M11)__GQ279383.1__N
auggccaccauggaggaaauccagagagagauuagcgcucacgaaggccaacuggugauagcaaggcagaaggucaaaaacgccgagaagcaguacgaaaaagaccccgaugaccucaauaagcgggcgcuucaugaucgcgaguccguugcugccucuauccagucaaaaauugacgagcugaagcgacaauuggcagaucguaucgccgcugggaagaacauuggacaggacagagauccuacagguguggaaccaggcgaccacuuaaaagagaggagugcacugagcuaugggaauacucuagaucucaacucccuggacaucgaugaaccgacgggacagaccgccgacuggcuuacaauaaucguauaccugacuucuuucgugguccccauuaucuugaaggcucucuauaugcugaccacacggggccgccagaccucgaaagauaauaaggguaugagaauuagguuuaaagacgacucaagcuacgaggaugugaacgggauccggaagccuaagcaucuguauguuaguaugccaaaugcccaauccucuaugaaagcggaggaaauaacucccggacgcuuccgaacagcagugugcggccucuacccugcccagauuaaggcuagaagcauggucuccccagugaugucaguaguuggcuuuuuagcccuggcaaaagacuggaccaguaggaucgaggaauggcuuggggcucccuguaaguucauggccgagagcccuauugcgggaucuuuguccgguaacccagugaaucgggauuauauccgucagcgcagaggcgcccuggcagggauggaaccgaaagaguuucaggcucuaaggcaacacgccaaggacgcuggaugcacgcucgucgagcauaucgaaucacccagcaguauuuggguguucgccggcgcaccugaucgguguccacccacuugccuguuugugggugggauggccgagcuuggagcuuucuuuucuauacugcaggacaugcgaaacaccaucauggcguccaaaacagucggcacugcagaugaaaaguugcgcaagaaaagcucguucuaccagucuuaccucagaaggacccaauccaugggcauucagcuggaccagcggaucauaguuauguuuaugguggccugggggaaggaggcuguagauaauuuccacuuaggagacgauauggacccugaacugcgcucacucgcccagauucuuaucgaccaaaaagugaaggagaucaguaaccaggagccaaugaaacuguga

SEQ ID NO: 5898 - RNA, 1290 nt, Artificial Sequence
  derived and/or modified CDS sequence (opt3) from SEOV(RuianRf74)__FJ803213.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaauggcagugugcggccucuacccugcccagauuaaggcuagaaauauggucagcccagugauguccguaguuggcuuuuuagcccuggcaaaagauuggacaucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacccucgucgagcauaucgaaucccccucaagcauuuggguguucgccggcgcaccugacagguguccacccacgugccuguuugugggugggauggccgagcuuggagcuuucuuuaguauacugcaggauaugcggaacacuaucauggcgucuaaaaccgucggcacagcagacgaaaaguugcgaaagaaauccagcuucuaccaaucguaccuccgcagaacucagucuaugggcauucagcuggaucagaggaucauaguuauguuuaugguggccugggggaaggaggcuguagacaauuuccacuuaggagaugacauugacccugaacugcggucccucgcccaaauccuuaucgaucagaaagugaaggagauuucaaaccaggagccaaugaaacuguga

SEQ ID NO: 5899 - RNA, 1290 nt, Artificial Sequence
  derived and/or modified CDS sequence (opt3) from SEOV(RuianRn23)__FJ803214.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacgcucgucgagcauaucgaaucccccucaagcauuuggguguucgccggcgcaccugacagguguccacccacuugccuguuugugggugggauggccgagcuuggagcuuucuuuaguauacugcaggauaugcggaacaccaucaaagcgucuaagacagucggcacugcagacgaaaaguugcgcaaaaaguccagcuucuaccaaucguaccuccgaagaacccagucuaugggcauucagcuggaucagaggaucauaguuauguuuaugguggccugggggaaagaggcuguagacaauuuccacuuaggagaugacauggacccugaacugcggucccucgcccaaauucuuaucgaucagaaggugaaagagaucucaaaccaggagccaaugaagcuguga

SEQ ID NO: 5900 - RNA, 1290 nt, Artificial Sequence
  derived and/or modified CDS sequence (opt3) from SEOV(RuianRn33)__FJ803215.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcgggaagccugucugguaacccagugaaucgggacuauauccgucagcgccagggcgcccuggcagggauggaaccgaaagaguuucaagcucuaagacagcacgccaaggaugcuggaugcacgcucgucgagcauaucgaaucccccucaagcauuuggguguucgccggcgcaccugacagguguccacccacuugccuguuugugggugggauggccgagcuuggagcuuucuuuaguauacugcaggauaugcggaacaccaucauggcgucuaaaacagucggcacugcagacgaaaaguugcgaaagaaauccagcuucuaccaaucguaccuccgcagaacccagucuaugggcauucagcuggaucagaggaucauaguuauguuuaugguggcccgggggaaggaggcuauguauaauuuacacuugcgcgacgauaugacaccucaacuccuucuguugguacagauucuacuggaccaccaggugaaagaaaucuccaaccaggagcucaugaagcuguga

SEQ ID NO: 5901 - RNA, 1290 nt, Artificial Sequence
  derived and/or modified CDS sequence (opt3) from SEOV(SC106)__GU361893.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuccaaugcccaacgcccaaaguuccaugaaagcggaggaaauaacuccuggacgcuuccgaacagcagugugcggccucuacccagcccagauuaaggcuagaaauauggucucucccgugaugagcguaguuggcuuuuuagcccuggcaaaagauuggaccuccaggaucgaggaauggcuuggggcuccuuguaaguucauggccgagucaccaauugcgggaaguuugagcgguaacccggugaaucgggacuauauccgucagcgccagggcgcccuggcagggauggaacccaaagaguuucaagcucuaagacagcacgccaaggaugcuggaugcacgcucgucgagcauaucgaaucuccuuccucaauuuggguguucgccggcgcaccagacaggugucccccuacuugccuguuugugggugggauggccgagcuuggagcuuucuuuagcauacugcaggauaugcggaacaccaucauggcgaguaaaacagucggcacugcagacgaaaaguugcgaaagaaaucuuccuucuaccaaagcuaccuccgcagaacccagucgaugggcauucagcuggaucagaggaucauaguuauguuuaugguggccugggggaaggaggcuguagacaauuuccacuuaggagaugacauggacccagaacugcggucucucgcccaaauucuuaucgaucagaaagugaaggagaucuccaaccaggagcccaugaaacuguga

SEQ ID NO: 5902 - RNA, 1290 nt, Artificial Sequence
  derived and/or modified CDS sequence (opt3) from SEOV(SEO/Belgium/Rn895/2005)__JQ898106.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgacaguccuauugcggguagcuugucuggaaacccagugaaucgggauuauauccgucagcgccagggcgcccuggcagggauggagccgaaagaauuucaagcucuaagacagcacuccaaggacgccggaugcacgcucgucgagcauaucgagucacccagcaguauuuggguguucgcuggcgccccugauagguguccacccacuugccuguuugugggugggauggcagaacuuggagccuucuuuucuauacugcaggacaugcggaacaccaucauggcuuccaaaacagucggcacugcggaugagaaguugcgaaagaaaagcucguucuaccaaucuuaccuccgcagaacccaguccaugggcauucagcuggaccagaggaucauaguuauguuuaugguggcaugggggaaggaagccguagauaauuuccacuuaggagacgacauggauccugagcugcggucacucgcucaaauucuuaucgaccagaaagugaaggaaaucaguaaccaggagccaaugaaacuguga

SEQ ID NO: 5903 - RNA, 1290 nt, Artificial Sequence
  derived and/or modified CDS sequence (opt3) from SEOV(Taonan420)__KF745951.1__N
auggccaccauggaggaaauccagagagagauuagcgcucacgaaggccaacuggugauagcaaggcagaacgucaaggacgccgagaaacaguacgaaaaggaucccgacgaucucaauaaacgggcgcuucaugaccgcgaguccguugcugccucuauccagucaaagauugaugagcugaaacgacaaccugcagaccguaucgccgcugggaagaacauuggacaggauagagacccaacagguguggaaccgggcgaucacuugaaggagaggagugcauuaagcuaugggaauacucuggaccuaaaccggcucgauaucgacgaacccacgggacagcgcgccgauuggcugaccauaaucguauaccuuacauccuucguggucagaauuauccugaaggcuuuguauauguuuucuacuaggggccggcagaccucgaaggacaauaaaggucuccgcauucgauucaaggacgauucaagcuacgaggacuuuaacgggaucagaaaaccuaagcaucuguaugugccaaugcccaaugcccaaaguuccaugaaggcggaggaaauaacaccuggaagguuccggaccgcaguuugcggccuguacccagcccagauuaaagcucguaacauggugucucccgucaugagcgugguaggcuuucucgccuuagcaaaggauuggacuucccgcaucgaggaauggcugggggcuccuuguaaauucauggccgagucaccaauugcgggaagucuuagcgguaauccgguuaacagagacuauaucaggcagcggcagggcgccuuggcagcuauggaacccaaggaguuucaagcccugcgacagcacgcuaaagauccugggugcacacugguggagcauaucgaaucuccauccucaauuugggucagcgccggagcacccgaccgcuguccuccaaccugccucuucgugggcgguauggccgagcugggggcguuuuucaguauauuucaggauaugagaaauacgaucaugcccucuaagacugugggaaccgcugacgaaaaacuuaggaagaagucccuguucuaccaaagcuacuugcggcgcacacagucgaugggcauucagcucgaucagagaaucauagucauguuuaugguugcauggggcaaagaggccguggacaacuuccaccuaccggaugacauggacccugaauuaaggucucuggcucaaauucucaucguacagaaggugaaagagaucuccaaucaggagcccaugaaacuuuga

SEQ ID NO: 5904 - RNA, 1290 nt, Artificial Sequence
  derived and/or modified CDS sequence (opt3) from SEOV(Taonan52)__KF745950.1__N
auggccaccauggaggaaauccagagagagauuagcgcucacgaaggccaacuggugacagcaaggcagaaggucaaagacgccgagaagcaguacgaaaaagaucccgacgaucucaacaagcgggcgcuucaugaccgcgaguccguugcugccucuauacagucaaaaaucgaugaggugaagcgacaacuggcagaccguauugccgcugggaagaauaucggacaggauagagacccuacugguguagaaccaggcgaucacccgaaagagaggagugcauugagcuaugggaacacguuagaccuaaauucccuggauauugacgaacccaccggacagacagccgauuggcucacuaucauaguguaccugaccucuuucgucgugccuaucauucuuaaggcucuguauaugucgacaacccggggccgccagacuucaaaagacaacagagguaugaggauccgguuucaagacgauagcaguuacgaggacguuaaugggauucgcaagccaaaacauuuguaugugcccaugccuaacgcccaguccucuaugaaggcggaggaagucacaccaggacgauucagaaccgcagugugcggccucuaccccgcccagaucaaggcuaggaauaugguacggccuguuaugagcguggucggcuuucuggcccuggcaaaggcuuggacgucccguauagaggaauggcucggggccccauguaaguucauggcggagucaccgauugccggaaguuuaagcgguaaccccguguaucgcgauuacaucagacagaggcaaggcgcacuggcugggauggaaccuaaagaguuucaggcccuucggcagcacgcuaaggacgccggaugcacuuugguggagcugauugaaucuccauccucaaucagcgucuucgcaggcgcccccgaucgauguccuagaaccugccuauuuguuggugggauggcugagcucggagcgaauuucaguaugcugcaagacaugucuaacacaaucauggcauccaaaacugugggcaccgccgaugaaaaacuucgcaaaaagagcucguuuuaccagucuuaucugaggcggacacaguccaugggcauucaguuggaccaacgcauaaucguaauguucaugguggcuucagggaaggaggccgucgauuacuuucaucucggagacgauauggacccagaacugagaaguuuagcacccauucugaucgaccagaaagugaaggagauaagcaaucaggagccgaugaaacucuga

SEQ ID NO: 5905 - RNA, 1290 nt, Artificial Sequence
  derived and/or modified CDS sequence (opt3) from SEOV(WuhanMm24)__JQ665911.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccgcugccgcaucuauccagucaaaaauugaugagcugaagcgacaauuggccgaccguaucgcugcagggaagaauauuggacaggauagagacccuacagguguugaaccaggcgaucacuuaaaagagaggagugcccugagcuaugggaacacucuagaccucaauucccuggauaucgacgaaccgacgggacagaccgcugauuggcuuacaauaaucguguaccugacuucuuucguagugcccauuaucuugaaggcccucuauaugcugaccacacggggccgccagaccucgaaagacaacaaggguaugagaauuagguuuaaagacgauucaagcuacgaggacgucaaugggauccggaagccuaagcaucuguaugugaguaugccaaacgcgcaauccucuaugaaagcagaggaaauaacucccggacgcuuccgaacagccguuugcggccucuacccugcucagauuaaggccagaaauauggugagcccagucauguccgugguaggcuuuuuagcacuggcuaaagauuggaccucaaggaucgaggaauggcuuggggcccccuguaaguucauggcggagaguccuauugccgguagcuugucuggaaacccaguuaaucgggacuauauccgucagcgccagggcgcacuggcugggauggaaccgaaagaguuucaagcccuaagacagcacuccaaggaugcuggaugcacgcucguggagcauaucgaaucacccagcaguauuugggucuucgccggcgcaccugacagguguccacccacuugccuguuugugggugggauggccggacuuggcgcuuucuuuucuauacugcaggauaugcggaacaccaucauggcguccaaaacagugggcacugcagacgagaaguugcgaaagaaaagcucguucuaccaaucuuaccuccgcagaacccaguccauggggauucagcuggaucagaggaucauagucauguuuaugguugccuggggaaaggaagcuguggacaauuuccacuuaggugaugacauggacccugagcugcggucacucgcccaaauucuuaucgaucagaaaguaaaggaaaucaguaaccaggagccaaugaaacuguga

SEQ ID NO: 5906 - RNA, 1290 nt, Artificial Sequence
  derived and/or modified CDS sequence (opt3) from SEOV(WuhanRf02)__JQ665912.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuagaggaaaggagugcacugagcuaugggaacacucuagaccucaauucccuggauaucgacgagccgacgggacagaccgccgauuggcuuacaauaaucguauaccugacuucuuucgugguccccauuaucuugaaagcucucuauaugcugaccacacggggccgccagaccucgaaggacaacaaagguaugagaauuagguuuaaggacgauucaagcuacgaggacgugaaugggauccggaaaccuaagcaucuguauguuaguaugccaaacgcccaauccucuaugaaggcggaagagauaacucccggacgcuuccgaacagcagugugcggccucuacccugcccagauuaaagcuagagauauggucagcccagugauguccguaguuggcuuuuuagcccuggcaaaggacuggaccucaaggaucgaagaguggcuuggggcucccuguaaauucauggccgaaaguccuauugcggguagcuugucuggaaauccagugaaccgggauuauauccgucagcgccagggcgcccuggcagggauggagccgaaggaguuucaagcucuaagacagcacuccaaagacgccggaugcacgcucgucgaacauaucgagucacccagcaguauuuggguguucgcuggcgccagggaucgguguccuccaacuugccuguuugugggugggauggcagaacuuggagccuucuuuucuauacugcaggacaugcgaaauaccaucauggcuuccaagacagucggcacugcggaugagaaauugcgcaaaaagagcucguucuaccaaucuuaccucagaaggacccaguccaugggcauucagcuggaccagcggaucauaguuauguuuaugguggcaugggggaaggaagccguagauaacuuccacuuaggagacgacauggaucccgagcugcgcucacucgcucaaauucuuaucgaccagaaggugaaagagaucaguaaucaggaaccuaugaagcuguga

SEQ ID NO: 5907 - RNA, 1290 nt, Artificial Sequence
  derived and/or modified CDS sequence (opt3) from SEOV(WuhanRf07)__JQ665913.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacuccaaggaugccggaugcacgcucgucgagcauaucgaaucacccagcaguauuuggguguucgcuggcgccagggaccgguguccuccaacuugccuguuugugggugggauggcagagcuuggagccuucuuuucuauacugcaggauaugcgaaacaccaucauggcuuccaaaacagucggcacugcggacgaaaaguugcgcaagaaaagcucguucuaccaaucuuaccucagaaggacccaguccaugggcauucagcuggaucagcggaucauaguuauguuuaugguggcaugggggaaggaggccguagacaauuuccacuuaggagaugacauggaccccgaacugcgcucacucgcucaaauucuuaucgaucagaaagugaaggagaucaguaaccaggagccuaugaaacuguga

SEQ ID NO: 5908 - RNA, 1290 nt, Artificial Sequence
  derived and/or modified CDS sequence (opt3) from SEOV(ZJ5)__FJ753400.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaaccuggugaaucgggacuauauccgucagcgccagggcgcccuagcagggauggaaccaaaagaguuucaagcucucagacagcacuccaaggaugccggaugcacgcuggucgagcauaucgaaucaccgagcaguauuuggguguucgcuggcgcccccgacagguguccuccaacuugccuuuuugugggugggauggcagagcugggagccuucuuuucuauauugcaggauaugcggaacaccaucauggcuuccaaaacagucggcacugcggacgaaaagcuccgaaagaaaagcucguucuaccaaucuuaccugcgcagaacccaguccaugggcauucaguuagaucagaggaucauaguuauguuuauuguggcaugggggaaggaggccguagacaauuuccaccugggagaugaccucgaccccgaacuucggucacuggcucaaaucuugaucgaucagaaagugaaggagauuaguaaccaggagccuaugaaacuauga

SEQ ID NO: 5909 - RNA, 1290 nt, Artificial Sequence
  derived and/or modified CDS sequence (opt3) from SEOV(ZT10)__AY766368.1__N
auggcccugugcgaggaaauccagagagagauuagcgcucacgaaggccaacucgugauagcaaggcagaaggucaaagacgccgagaagcaguacgaaaaagaucccgacgauuucaacaagcgggcgcuucaugaccgcgaguccguugcugccucuauccagucaaaaauugaugagcugaagcgacaauuggcagaccguaucgccgcugggaagaauauuggacaggauagagacccuaccgguguggaaccaggcgaucacuuaaaagagaggagugcacugagcuaugggaacacacuagaccucaauucccuggauaucgacgaaccgacuggacagacggccgauuggcuuaccauaaucguauaccugacaucuuuugugguccccauuaucuugaaggcucucuauaugcugacuacccggggccgccagacaucgaaagacaacaaggguaugagaauuagguucaaagacgauucaagcuacgaggacgugaaugggauccggaagccuaagcaucuguauguuaguaugccaaacgcccaauccucuaugaaagcggaggaaauaacccccggacgcuuucgaacugcaguguguggccucuacccugcccagauuaaggcuagaaauauggucagcccagugauguccguaguuggcuucuuagcccuggcaaaagauuggacaucaaggaucgaggaauggcuuggggcucccugcaaguuuauggccgagaguccuauugcggguagcuugucuggaaacccagugaaucgggacuauauccgucagcgccagggcgcccuggcagggauggaaccgaaagaguuccaagcucuaagacagcacgccaaggaugcuggauguacccucgucgagcauaucgaaucccccucaagcauuuggguguuugccggcgcaccugacaggugcccacccacgugucuguucgugggugggauggccgagcuuggagcguuuuucaguggccuggcugauaugcggaacacuauaauggcaucuaaaaccgaaggcacagccgacgagaaguugcgaaagaaauccagcuuuuaccagucguaccuccgcagacaacagucuauggggauccagcuggaucagaggauuaucgucauguucaugguugcuuggggaaaggaagccguggacaauuuucacuuaggugaugacauggacccugagcugcggucccucgcacaaauacuuauugaucagaaaguaaaggagaucucaaaccaggaaccaaugaaacuguga

SEQ ID NO: 5910 - RNA, 1290 nt, Artificial Sequence
  derived and/or modified CDS sequence (opt3) from SEOV(ZT71)__AY750171.1__N
auggccaccauggaggaaauccagagagagauuagcgcucacgaaggccaacuggugauagcaaggcagaaggucaaagacgccgagaagcaguacgaaaaagaucccgacgauuucaacaagcgggcgcuccaugaccgcgaguccguugcugccucuauccagucaaaaauugaugagcuuaagcgacaacuggcagaccguaucgccgcugggaagaauauuggacaggauagagacccuacagguguggaaccaggcgaucacuugaaagagaggagugcauuaagcuaugggaacacucuggaccuaaauucccucgauaucgacgaaccgacgggacagaccgccgauuggcugacaauaaucguauaccuuacuucuuuugugguccccauuauccugaaggcuuuguauaugcucaccacacggggccgccagaccucgaaagacaacaaggguaugagaauuagguucaaagacgauucaagcuacgaggacgugaaugggauccggaagccuaagcaucuguauguuaguaugccaaacgcccaauccucuaugaaagcggaggaaauaacucccggacgcuuucgaacagcagugugcggccuguacccugcccagauuaaggcuagaaauauggucagcccagugauguccguaguuggcuuccucgccuuagcaaaagauuggaccucaaggaucgaggaauggcugggggcucccuguaaguuuauggccgagaguccuauugcgggaagccuuucugguaacccagugaaucgggacuauauccgucagcgccagggcgccuuggcagggauggaaccgaaagaguuccaagcucugagacagcacgccaaggaugcuggaugcacgcuagucgagcauaucgaaucccccucaagcauuuggguguuugccggcgcaccugacagguguccacccacuugccucuucgugggugggauggccgagcugggagcguuuuucaguauacuucaggauaugcggaacaccaucauggcuucuaaaacagaaggcacugcagacgagaagcugcgaaagaaauccagcuuuuaccaaucguacuugcgcagacagcagucuaugggcauucagcucgaucaaaggaucauagucauguucaugguugccugggggaaggaagcuguggacaauuuucaccugggagaugacauggacccugaguuacggucccuggcccagauucucaucgaucagaaaguaaaggagaucucaaaccaggaaccaaugaaacuuuga

SEQ ID NO: 5911 - RNA, 1290 nt, Artificial Sequence
  derived and/or modified CDS sequence (opt3) from SEOV(zy27)__AF406965.1__N
auggccaccauggaggaaauccagagagagauuagcgcucacgaaggccaacuggugauagcaaggcagaaggucaaagacgccgagaagcaguacgaaaaagaucccgacgauuccaacaagcgggcgcuccaugaccgcgagucuguugcugccucaauccagaguaaaauugaugagcuuaagcgacaacuggcagaccguaucgccgcugggaagaauauuggacaggauagagacccuacagguguggaaccaggcgaucacuugaaagagaggagcgcaccguccuaugggaacacuuuagaccuuaauucucuagauaucgacgaacccacgggacagaccgccgauuggcucacaauaaucguauaccugacuucguucguggucccuauuauccuuaaggcucuguauauguugaccacacggggccgccagaccucaaaagacaacaaggguaugagaauuagguuuaaagacgauagcaguuacgaggacgugaaugggauccggaagccaaagcaucucuauguuuccaugcccaacgcccaaucuagcaugaaagcggaggaaauaacuccugagcgcuuccgaacagcagugugcggacuguacccagcccagauuaaggcuagaaauauggucucccccgugaugucaguaguuggcuuucuggcccucgcaaaagauuggaccaguaggaucgaagagugguuaggcgcuccuuguaaguucauggccgaaagcccaauugcggggucucuguccggaaacccggugaaucgggaccacauccgucagcgccagggugcccuugcaggcauggagcccaaagaguuucaggcuuugagacaacaugccaaggaugcugggugcacgcuggucgaacacaucgagucaccuagcaguauuuggguguucgccggagcaccagacaggugucccccuacuugccuauuugugggcgguauggccgaacucggggcuuucuuuucuauacugcaggauaugcggaacaccaucauggcguccaaaacagucggaacugcagacgagaagcugcgaaagaaaagcucguucuaucaaucuuaccugcgcagaacccaguccaugggcauucaguuggaucagaggaucauaguuauguuuaugguggccuggggcaaggaagcuguagacaauuuccaccucggggaugacauggacccagagcugcggucauuagcccaaauucugaucgaucagaaagugaaggagaucaguaaccaggaacccaugaaacucuga

SEQ ID NO: 5912 - RNA, 1290 nt, Artificial Sequence
  derived and/or modified CDS sequence (opt3) from SEOV(DN2)__KX289954.1__N
auggccaccauggaggaaauccagagagagauuagcgcucacgaaggccaacuggugauagcaaggcagaaggccaaagacgcggagaagcaguacgaaaaagaucccgacgaucucaacaagcgggcccuucaugaccgcggguccgucgcugcaucuauccagucaaaaauugaugagcugaagcgacaauuggccgaccguaucgcugcaggaaagaauauuggucaggauagagacccuacaggcguugagccaggggaucacuuaaaagaaaggagugcccugagcuauggaaacacucuagaccucaauucccuggauaucgacgagccgacgggccagaccgcugauuggcuuacaauaaucguguaccugacuucuuucguagugcccauuaucuugaaggcccucuauaugcugaccacacggggucgccagaccucgaaagacaacaaggggaugagaauuagguuuaaagacgauucaagcuacgaagacgucaauggaauccggaagccuaagcaucuguaugugaguaugccaaacgcgcaauccucuaugaaagcagaggagauaacucccggccgcuuccgaacagccguuugcggccucuacccugcucagauuaaggccagaaauauggugagcccagucauguccgugguaggguuuuuagcacuggcuaaagauuggaccucaaggaucgaagaguggcuuggagaacccuguaaguucauggccgagaguccuauugcggguagcuugucuggcaacccaguuaaucgggacuauauccgucagcgccagggggcccuggcaggaauggaaccgaaagaguuucaagcucuaagacagcacuccaaggaugccggcugcacgcucguggagcauaucgaaucacccagcaguauuugggucuucgcuggugccccugacagguguccacccacuugccuguuugucgggggaauggcagagcuuggcguguucuuuucuauacugcaggauaugcggaacaccaucauggccuccaaaacagugggcacugcugacgaaaaguugcgaaagaaaagcucguucuaccaaucuuaccuccgcagaacccaguccauggggauucagcuggaucagaggaucauaguuauguuuaugguggcguggggaaaggaggcaguagacaauuuccacuuaggugaugacauggacccugaacugcggucacucgcccaaauucuuaucgaucagaaagugaaggagaucaguaaccaggagccaaugaaacuguga

SEQ ID NO: 5913 - RNA, 1290 nt, Artificial Sequence
  derived and/or modified CDS sequence (opt3) from SEOV(IR162)__KX079476.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuugacacgcccuguaaguucaugguggagaguccuauugcugggagcuugucuggaaacccagucaaucgggauuauauccgucagcgccagggugcccuggcgggcauggaaccgaaagaguuucaagcccuaagacagcacuccaaggacgcagggugcacucucguggagcauaucgaaucacccagcaguauuuggguguucgcuggagccccugauagguguccaccuaccugccuguuugucggcgguauggcugagcuuggggccuucuuuucuauacugcaggacaugcggaacacaaucauggcauccaaaacuguuggaaccgccgaugaaaaguugcgaaagaaaagcucguucuaccaaucuuaccuccgcagaacacaguccaugggcauucagcuggaccagaggaucauagugauguuuaugguagcuuggggcaaggaggcgguggauaauuuccacuuaggggacgacauggaucccgaacugcggucacucgcacaaauucuuaucgaccagaaagucaaggagaucaguaaccaggagccaaugaaacuguga

SEQ ID NO: 5914 - RNA, 1290 nt, Artificial Sequence
  derived and/or modified CDS sequence (opt3) from SEOV(Gou3)__AF184988.1__N
auggccaccauggaggaaauccagagagagauuagcgcucacgaaggccaacuggugauagcaaggcggaaggucaaagacgccgagaagcaguacgaaaaagaucccgacgaucucaacaagcgcgcgcuucaugaccgagaguccguugcugccucuauccagucaaaaauugaugagcugaagcgucaguuggcagacagaaucgccgcugggaagaauauuggacaagauagggacccuacagguguggaaccaggcgaucacuuaaaagagcggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacgcggcagacagaccucgaaagacaacaaggguaugaggauucgguuuaaagacgauucaagcuacgaggacgugaaugggauccgcaagccuaagcaucuguauguuaguaugccaaacgcccaguccucuaugaaagcggaggaaauaacucccggacgauucagaacagcagugugcggccucuacccugcccaaauuaaggcuaggaauauggucagcccagugauguccguaguuggcuuuuuagcccuggcaaaagauuggaccucacggaucgaggacuggcuuggggcucccuguaaguucauggccgaaaguccuauugcggguagcuugucuggaaacccagugaaucgugauuauauccgccagagacagggcgcccuggcagggauggagccgaaagaauuucaggcucuaaggcaacacuccaaggacgccggaugcacgcucgucgagcauaucgagucacccagcaguauuuggguguucgcuggcgccccugaucgguguccacccacuugccuguuugugggugggauggcagaacuuggagccuucuuuuucauacugcaggacaugcgaaacaccaucauggcuucuaaaacagucggcacugcggaugagaaguugcgcaagaaauccagcuuuuaccagucguaccucagaaggacccaaucuaugggcauucagcuggaccagcggaucauaguuauguucaugguggcaugggggaaggaagccguagauaauuuucacuuaggagacgacauggauccugagcugcgcucccucgcucagauucuuaucgaccaaaaagugaaggaaaucucaaaccaggagccaaugaaacuguga

SEQ ID NO: 5915 - RNA, 1290 nt, Artificial Sequence
  derived and/or modified CDS sequence (opt3) from SEOV(Gou3-v9)__AF288651.1__N
auggccaccaaggaggaaauccagagagagauuagcgcucacgaaggccaacuggugauagcaaggcagaaagucaaggacgccgagaaacaguacgaaaaggaucccgacguucucaacaaacgggcgcuucaugaucgcgaguccguggcugccucuauccagucaaagauugacgagcugaagcgacaauuggcagaucguaucgccgcugggaaaaguauuggacaggacagagauccuacagguguagaaccaggcgaccacuuaaaggagaggagcgcacuguccuaugggaauacucuagaucucaacucucuggacaucgaugaaccgacgggacagaccgccgacuggcuuacaauaaucguguaccugacuucguucgucgugcccauuaucuugaaagcucucuauaugcugaccacacggggccgccagaccucaaaggauaauagagguaugaggauucgguuuaaagacgacagcaguuacgaggauguuaacgggauccgcaagccuaagcaucuguauguguccaugccaaaugcccaaucuagcaugaaagcggaggaaauaacucccggacgauucagaacagcagucugcggccucuacccugcccagauuaaggcuaggaacaugguguccccaguaaugucaguugugggcuuuuuagcccuggcaaaagacuggaccagucggaucgaggauuggcuuggggcucccuguaaguucauggccgaaagcccuauugcgggaucuuuguccgguaauccagucaaccgugacuauauccgccagagacagggcgcccuggcagggauggagccgaaagaauuucaagcucuaaggcagcacucaaaggaugccggaugcacgcucguggagcauaucgagagccccaguucuauuuggguguucgcuggcgccccugaccgguguccacccacuugccuguuugucggugggauggcagaacuuggagccuucuuuuccauacugcaggauaugcgaaauaccaucauggcuagcaaaacaguuggcacugcggacgagaaguugcgcaagaaaucgucuuucuaccaauccuaccucagaaggacccagucaaugggcauucagcuggaucagcggaucauagugauguuuaugguagcaugggggaaggaagccguggacaacuuccacuuaggagaugacauggacccugagcugcgcagucucgcucaaauucuuaucgaucagaaagucaaggaaaucagcaaucaggagccaaugaaacuguga

SEQ ID NO: 5916 - RNA, 1290 nt, Artificial Sequence
  derived and/or modified CDS sequence (opt3) from SEOV(IR461)__AF329388.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguauuagaaucagguuuaaagacgauucaagcuacgagaaugugaacgggauacggaagccuaagcaucuguauguuaguaugccaaaugcccaauccucuaugaaagcggaggaaauuacucccggacgcuuccgaacagcagugugcggccucuacccugcccagaucaaggcuggcaacauggucagcccagugauguccguaguuggguuuuuagcccuggcaaaagacuggaccucaagaauugaggaauggcuugauacgcccuguaaguucaugguggagaguccuaucgcugguagcuugucuggaaauccagucaacagggacuauauccggcagcgucagggcgcccuggcggggauggaaccgaaagaguuucaagcccuacgccagcacuccaaggaugcaggaugcacucucguggagcauauugaaucacccagcaguauauggguguucgcuggcgccccugacagauguccaccuaccugccuguuugucggugggauggcugagcuuggagccuucuuuucuauccugcaggauaugaggaauacaauuauggcauccaaaacuguuggcaccgccgacgaaaaguugcggaagaaaagcucguucuaccaaucuuaccuccgacgcacacaguccaugggcauccagcuggaucagagaauaauugugauguuuaugguagcuugggggaaggaggcgguggacaacuuccacuuaggagaugacauggaccccgaacugaggucacucgcacaaauccuuaucgaucagaaagucaaggagauuaguaaucaggagccaaugaaacuguga

SEQ ID NO: 5917 - RNA, 1290 nt, Artificial Sequence
  derived and/or modified CDS sequence (opt3) from SEOV(JUN5-14)__DQ217791.1__N
auggccaccauggaggaauuucagagagagaucagcgcucacgaaggccaacuggugauugcaaggcagaaggucaaagacgccgagaagcaguacgaaaaagaucccgacgaucucaacaagcgggcgcuucaugaccgcgaguccguugcugccucuauacagucaaaaaucgaugagcugaagcgacaauuggcagaccguauugccgcugggaagaauaucggacaggauagagacccuacagguguggaaccaggcgaucacuuaaaagagaggagugcacugagcuaugggaacacucuagaccucaauucccuggauauugacgaaccgacgggacagaccgccgauuggcuuacaaucauaguauaccugacuucuuuugugguccccaucauuuugaaggcucucuauaugcugaccacacggggccgccagaccucgaaagacaacaaggguaugagaaucagguucaaagacgauucaagcuacgaggacgugaaugggauucggaagccuaagcaucuguauguuaguaugccaaacgcccaauccucuaugaaagcggaggaaaucacucccggacgcuuucgaacagcagugugcggccucuacccugcccagauaaaggcuagaaauauggucagcccagugauguccguaguuggcuucuuagcccuggcaaaagauuggaccucaaggauugaggaauggcuuggggcucccuguaaguuuauggccgagaguccuaucgcggguagcuugucuggaaacccagugaaucgggacuauauucgucagcgccagggcgcccuggcagggauggaaccgaaagaguuccaagcucuaagacagcacgccaaggaugcuggaugcacgcucgucgagcauaucgaaucccccucaagcaucuggguguuugccggcgcaccugacagguguccacccacuugccuguucgugggugggauggccgagcuuggagcuuucuucaguauucugcaggauaugcggaacaccauaauggcgucuaaaacagucggcacugcagacgaaaaguugcgaaagaaauccagcuuuuaccaaucguaccuccgcagaacccagucuaugggcauccagcuggaucagaggauuaucguuauguucaugguggccugggggaaggaggcuguagacaauuuucacuuaggagaugacauggacccugaacugcggucccucgcccaaauacuuauugaucagaaagugaaggagaucucaaaccaggagccaaugaaacuguga

SEQ ID NO: 5918 - RNA, 1290 nt, Artificial Sequence
  derived and/or modified CDS sequence (opt3) from SEOV(L99)__AF488708.1__N
auggccaccauggaggaaauccagagagagauuagcgcucacgaaggccaacuggugauagcaaggcagaaggucaaagacgccgagaagcaguacgaaaaagaucccgacgaucucaacaagcggacacuucaugaccgcgaguccguugcggcuucuauccagucaaaaauugaugagcugaagcgacaauuggccgaccguaucgcagccgggaagaauauuggacaggauagagacccuacugguguggaaccaggcgaucacuuaaaagagaggagugcucugagcuaugggaacacgcuagaccucaauucccuggauaucgacgaaccgaccggacagacagcagauuggcuuacuauaaucguauaccugaccucuuucgugguccccauuaucuugaaggcccucuauaugcugacaacccggggccgccagacuucgaaagacaacaaggguaugagaauuagguuuaaagacgauucaagcuacgaggacgugaaugggauccggaagccuaagcaucuguauguuaguaugccaaacgcucaauccucuaugaaagccgaggaaauaacacccggacgcuuccgaaccgcggugugcggccucuacccugcacagauuaaggccagaaauauggucagcccagugauguccguaguuggcuuuuuagcucuggccaaagauuggacgucaaggaucgaggaauggcuuggggcacccuguaaguucauggcugagaguccuauugccgguagcuugucuggaaacccagugaaucgggacuauauccgucagcgccagggcgcgcuggccgggauggaaccgaaagaguuucaagcacuaagacagcacgcuaaggaugccggaugcacucucgucgagcauaucgaaucccccucaagcauuuggguguucgcuggcgccccugacagguguccaccuaccugccuguuugugggugggauggcagagcuuggagccuucuuuaguauacugcaggauaugcggaacacaaucauggcuucuaaaacugucggcaccgcggacgaaaaguugcgaaagaaauccagcuucuaccaaucguaccuccgcagaacacagucuaugggcauucagcuggaucagaggaucauaguuauguuuaugguggcaugggggaaggaggccguagacaauuuccacuuaggagaugacauggaccccgaacugcggucccucgcucaaauucuuaucgaucagaaagugaaggagaucucaaaccaggagccaaugaaacuguga

SEQ ID NO: 5919 - RNA, 1290 nt, Artificial Sequence
  derived and/or modified CDS sequence (opt3) from SEOV(R22)__AF488707.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuuggggcucccuguaaguucauggccgagaguccuauugcggguagcuugucuggaaacccagugaaucgggacuauauccgucagcgccagggcgcccuggcagggauggaaccgaaagaguuucaagcucuaagacagcacgccaaggaugcuggaugcacgcucgucgagcauaucgaaucccccucaagcauuuggguguucgccggcgcaccugacagguguccacccacuugccuguuugugggucggauggccgagcuuggggcuuucuuuaguauacugcaggauaugaaaaacaccaucauggcgucuaagacagucggaacugcagacgaaaaguugcgcaaaaaguccagcuucuaccaaucguaccuccgaagaacccagucuaugggcauucagcuggaucagaggaucauaguuauguuuaugguggccuggggcaaagaggcuguagacaauuuccacuuaggggaugacauggacccugaacugcggucccucgcccaaauucuuaucgaucagaaggugaaagagaucucaaaccaggagccaaugaagcuguga

SEQ ID NO: 5920 - RNA, 1290 nt, Artificial Sequence
  derived and/or modified CDS sequence (opt3) from SEOV(TURCKHEIM/Hu/FRA/2016/2016.00044)__KX064270.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguaucgccgcugggaagaauauuggacaggauagagacccuacagguguggaaccaggcgaucacuuaaaagagaggagugcacugagcuaugggaacacucuagaccucaauucccuggauaucgacgaaccgacgggacagaccgccgauuggcuuacaauaaucguauaccugacuucuuucgugguccccauuaucuugaaggcucucuauaugcugaccacacggggccgccagaccucgaaagacaacaaggguaugagaauuagguuuaaagacgauucaagcuacgaggacgugaaugggauccggaagccuaagcaucuguauguuaguaugccaaacgcccaauccucuaugaaagcggaggaaauaacucccggacgcuuccgaacagcagugugcggccucuacccugcccagauuaaggcuagaaauauggucagcccagugauguccguaguuggcuuuuuagcccuggcaaaagauuggaccucaaggaucgaggaauggcuugacgcucccuguaaguucauugccgagaguccuaucgcggggagcuugucuggaaacccagugaaucgggauuauauccgucagcgccagggugcccuggcaggcauggaaccgaaagaguuucaagcucuaagacagcacuccaaggacgccgggugcacgcucgucgagcauauugaaucacccagcaguauauggguguucgcuggagccccugauagguguccacccacuugccuguuugugggcgguauggcagagcuuggggccuucuuuucuauccugcaggacaugcggaacaccauuauggcuuccaaaacagucggaacugcggaugaaaaguugcgaaagaaaagcucguucuaccaaucuuaccuccgcagaacccaguccaugggcauccagcuggaccagaggauaauuguuauguuuaugguggcauggggcaaggaggccguagauaauuuccacuuaggggacgacauggauccugaacugcggucacucgcucaaauccuuaucgaccagaaagugaaggagauuaguaaccaggagccaaugaaacuguga

SEQ ID NO: 5921 - RNA, 1290 nt, Artificial Sequence
  derived and/or modified CDS sequence (opt3) from SEOV(Z37)__AF187082.1__N
auggccaccauggaggaaauccagagagagauuagcgcucacgaaggccaacuggugauagcaaggcagaaggucaaagacgccgagaagcaguacgaaaaagaucccgacgauuucaacaagcgggcgcuccaugaccgcgaguccguugcugccucuauccagucaaaaauugaugagcuuaagcgacaacuggcagaccguaucgccgcugggaagaauauuggacaggauagagacccuacagguguggaaccaggcgaucacuugaaagagaggagugcauuaagcuaugggaacacucuggaccuaaauucccucgauaucgacgaaccgacgggacagaccgccgauuggcugacaauaaucguauaccuuacuucuuuugugguccccauuauccugaaggcuuuguauaugcucaccacacggggccgccagaccucgaaagacaacaaggguaugagaauuagguucaaagacgauucaagcuacgaggacgugaaugggauccggaagccuaagcaucuguauguuaguaugccaaacgcccaauccucuaugaaagcggaggaaauaacucccggacgcuuucgaacagcagugugcggccuguacccugcccagauuaaggcuagaaauauggucagcccagugauguccguaguuggcuuccucgccuuagcaaaagauuggaccucaaggaucgaggaauggcugggggcucccuguaaguuuauggccgagaguccuauugcgggaagccuuucugguaacccagugaaucgggacuauauccgucagcgccagggcgccuuggcagggauggaaccgaaagaguuccaagcucugagacagcacgccaaggaugcuggaugcacgcuagucgagcauaucgaaucccccucaagcauuuggguguuugccggcgcaccugacagguguccacccacuugccucuucgugggugggauggccgagcugggagcguuuuucaguauacuucaggauaugcggaacaccaucauggcuucuaaaacagucggcacugcagacgaaaagcugcgaaagaaauccagcuuuuaccaaucguacuugcgcagaacccagucuaugggcauucagcucgaucagaggaucauagggauguucaugguugccuggggaaaggaggcuguggacaauuuucaccugggugaugacauggacccugaauuacggucccuggcccaaauucucaucgaucagaaaguaaaggagaucucaaaccaggagccaaugaaacuuuga

SEQ ID NO: 5922 - RNA, 1290 nt, Artificial Sequence
  derived and/or modified CDS sequence (opt3) from SEOV(Tchoupitoulas (TCH))__AF329389.1__N
auggccaccauggaggaaauccagagagagauuagcgcucacgaaggccaacuggugauagcaaggcagaaggucaaagacgccgagaagcaguacgaaaaagaucccgacgauuucuauaagcgggcgcuccaugaccgcgaguccguugcugccucuauccagucaaaaauugaugagcuuaagcgacaacuggcagaccguaucgccgcugggaagaacauuggacaggauagagacccuacagguguggaaccaggcgaucacuugaaagagaggagugcauuaagcuacgggaauacucuggaccuaaacucccucgauaucgacgaaccgacgggacagaccgccgauuggcugacaauaaucguauaucuuacuucuuuugugguccccauuauccugaaggcuuuguacaugcucaccacacggggccgccagaccucgaaagacaauaaggguaugagaauuagguucaaagacgauucaagcuaugaggacgugaacgggauccggaagccuaagcaucuguacguuaguaugccaaaugcccaauccucuaugaaagcggaggaaauaacucccggacgcuuucgaacagcagugugcggccuguauccugcccagauuaaggcuagaaacauggucagcccagugauguccguaguuggcuuccucgccuuagcaaaagauuggaccucaaggaucgaggaauggcugggggcucccuguaaguuuauggccgagaguccuauugcgggaagccuuucugguaauccagugaaccgggacuacauccgucagcgccagggcgccuuggcagggauggaaccgaaagaguuccaagcucugagacagcacuccaaggaugccggaugcacgcuagucgagcauaucgaaucacccagcaguauuuggguguuugcuggcgccccugacagguguccacccacuugccucuucgugggugggauggcagagcugggagccuuuuucucuauacuucaggauaugcggaauaccaucauggcuuccaaaacagucggcacugcggacgaaaagcugcgaaagaaaagcucguuuuaccaaucuuauuugcgcagaacccaguccaugggcauucagcucgaucagaggaucauaguuauguucaugguggcaugggggaaggaggccguagacaacuuucaccugggagaugacauggacccugaauuacggucacuggcucaaauucucaucgaucagaaagugaaggagaucaguaaucaggagccaaugaaacuuuga

SEQ ID NO: 5923 - RNA, 1290 nt, Artificial Sequence
  derived and/or modified CDS sequence (opt3) from SEOV__M34881.1__N
auggccaccauggaggaaauccagagagagauuagcgcucacgaaggccaacuggugauagcaaggcagaaggucaaagacgccgagaagcaguacgaaaaagaucccgacgaucucaacaagcgggcgcuucaugaccgcgaguccguugcugccucuauccagucaaaaauugaugagcugaagcgacaauuggcagaccguuuacagcaggggagaacaaguggacaggauagggacccuacugguguggaaccaggcgaucaccugaaggagcggagcgcccuauccuaugggaauacgcucgaccugaacucucuugauaucgacgaaccgaccggacaaacagcugauuggcugacuauuaucguauacuugaccucguucgugguccccauaauccucaaagcacuguauaugcugacaacccgcggcagacagacuucaaaggacaauaaagguaugaggauucgguuuaaggacgauagcaguuacgaggacgugaacgggauccgcaaaccuaagcaucucuauguuuccaugccaaaugcccagucuagcaugaaggcugaggaaauuacacccggacgauucagaaccgccgugugcggcuuauacccugcgcagaucaaagcaaggaacauggucuccccagugaugucaguaguuggcuuucuggcccuugcuaaggauuggacgagucggauagaggaaugguugggggcccccuguaaauucauggcagagagccugauugcuggaucucuauccgguaauccugugaaccgugacuauauccgccaaagacagggcgcccucgcggggauggaaccaaaggaguuucaggcccugaggcaacacucaaaagaugcaggaugcacucuugucgagcauauugaaagcccgaguucuaucuggguguucgcuggcgcccccgaccgguguccuccaaccugccuguuugugggugggauggcugaguugggagccuucuuuuccauccuccaggauaugcgaaauacaauuauggcaagcaagacugucggcaccgccgacgaaaaacugcgcaagaagucgucuuucuaccaguccuacuuaagaaggacacagucaaugggcauacaacuggaucagcggaucauuguuauguuuaugguggcuugggggaaagaggcgguagacaacuuccaccucggagaugacauggaccccgaacuucgcagucuggcacagaucuugauagaucagaaggugaaagagauuagcaaucaagagccuaugaagcuauga

SEQ ID NO: 5924 - RNA, 1287 nt, Artificial Sequence
  derived and/or modified CDS sequence (opt3) from SNV(H10)__NC_005216.1__N
augagcacccugaaggaggugcaggacaacaucacacuccacgaacaacagcuugucacugccagacagaaacugaaggaugcugagagggcaguugaauuggaccccgaugacgugaauaaauccacguuacagucucggcgcgccgcgguaucagcucuggagaccaagcuaggcgaacucaaacgagagcuggccgaucuuauugcagcccaaaagcuggcuaguaagccuguggacccaacagggauagagccggaugaccauuugaaagaaaagagcucccuccguuacggaaacguccuggauguuaauucuaucgaccuggaggaacccucgggucagacugcagauuggaaaucaauuggccucuauaucuugagcuucgcccugccuauuauccuuaaggcuuuguacaugcugaguaccagagggaggcagacaauaaaagagaacaagggaacccggauccgcuuuaaggacgauuccucuuaugaggaagugaauggcauuagaaaaccaaggcaccuauacgugagcaugcccacugcccaguccacaaugaaggcggacgagaucaccccuggucgguuccgcacgauugcaugcgggcucuuuccagcccaagucaaagcucgaaacaucauaucacccgugaugggaguaauuggcuucagcuuuuucguuaaggacuggauggaaagaaucgaugacuuucuggccgcaagguguccuuuccuuccagagcagaaagauccgcgggacgcugcccuggcgacuaaucgugccuauuuuauuacccgccaguuacagguggaugaaaguaaggucucugacaucgaggaucucaucgcagacgcuagagccgaguccgcuacaauuuucgccgauauagcaacuccccauucaguguggguguuugccugcgcuccugacagguguccacccaccgcgcuguacgucgcaggcaugccugaauuaggggccuucuuugcuauccugcaagauaugcggaacacaauuauggccagcaaaaguguuggaaccucugaggaaaagcucaagaaaaaguccgcauucuaucagagcuaccuucgacgcacgcagucgauggguauccaacuggaccagaaaauaauuaucuuguacaugucucacuggggcagagaggccgugaaucauuuccaccuaggggacgauauggacccagaacugagggagcucgcucagacucugguagauaucaaggugcgggagauuuccaaccaggaaccccuuaaacuguga

SEQ ID NO: 5925 - RNA, 1287 nt, Artificial Sequence
  derived and/or modified CDS sequence (opt3) from SNV(2)__JQ690282.1__N
augagcacccugaaggaggugcaggacaacaucacacuccacgaacaacagcuugucacugccagacagaaacugaaggaugcugagagggcaguugaauuggaccccgaugacgugaauaaauccacguuacagucucggcgcgccgcgguaucagcucuggagaccaagcuaggcgaacucaaacgagagcuggccgaucuuauugcagcccaaaagcuggcuaguaagccuguggacccaacagggauagagccggaugaccauuugaaagaaaagagcucccuccguuacggaaacguccuggauguuaauucuaucgaccuggaggaacccucgggucagacugcagauuggaaaucaauuggccucuauaucuuaaguuucgcccugccuauuauccuuaaggcuuuguacaugcugaguaccagagggaggcagacaauaaaagagaacaagggaacccggauccgcuuuaaggacgauuccucuuaugaggaagugaauggcauuagaaaaccaaggcaccuauacgugagcaugcccacugcccaguccacaaugaaggcggacgagaucaccccuggucgguuccgcacgauugcaugcgggcucuuuccagcccaagucaaagcucgaaacaucauaucacccgugaugggaguaauuggcuucagcuuuuucguuaaggacuggauggaaagaaucgaugacuuucuggccgcaagguguccuuuccuuccagagcagaaagauccgcgggacgcugcccuggcgacuaaucgugccuauuuuauuacccgccagaugcaaguggaugaaagcaaggucucugacaucgaggauuugaucgcagacgcuagagccgaguccgcuacaauuuucgccgauauagcaacuccccauucaguguggguguuugccugcgcuccugacagguguccacccaccgcgcucuacgucgcaggcaugccugaacugggggccuucuuugcuaucuuacaggauaugcggaacacaauuauggccagcaaaaguguuggaaccucugaggaaaagcugaagaaaaaguccgcauucuaucagagcuaccuccgacgcacgcagucgauggguauccaacuugaccagaaaauaauuauccuguacaugucucacuggggcagagaggccgugaaucauuuccacuugggggacgauauggacccagaacuaagggagcuggcucagacucucguagauaucaaggugcgggagauuuccaaccaggaaccccugaaacuuuga

SEQ ID NO: 5926 - RNA, 1287 nt, Artificial Sequence
  derived and/or modified CDS sequence (opt3) from SNV(3)__JQ690278.1__N
augagcacccugaaggaggugcaggacaacaucacacuccacgaacaacagcuugucacugccagacagaaacugaaggaugcugagagggcaguugaauuggaccccgaugacgugaauaaauccacguuacagucucggcgcgccgcgguaucagcucuggagaccaagcuaggcgaacucaaacgagagcuggccgaucuuauugcagcccaaaagcuggcuaguaagccuguggacccaacagggauagagccggaugaccauuugaaagaaaagagcucccuccguuacggaaacguccuggauguuaauucuaucgaccuggaggaacccucgggucagacugcagauuggaaaucaauuggccucuauaucuugagcuucgcccugccuauuauccuuaaggcuuuguacaugcugaguaccagagggaggcagacaauaaaagagaacaagggaacccggauccgcuuuaaggacgauuccucuuaugaggaagugaauggcauuagaaaaccaaggcaccuauacgugagcaugcccacugcccaguccacaaugaaggcggacgagaucaccccuggucgguuccgcacgauugcaugcgggcucuuuccagcccaagucaaagcucgaaacaucauaucacccgugaugggaguaauuggcuucagcuuuuucguuaaggacuggauggaaagaaucgaugacuuucuggccgcaagguguccuuuccuuccagagcagaaagauccgcgggacgcugcccuggcgacuaaucgugccuauuuuauuacccgccaguuacagguggaugaaaguaaggucucugacaucgaggaucucaucgcagacgcuagagccgaguccgcuacaauuuucgccgauauagcaacuccccauucaguguggguguuugccugcgcuccugacagguguccacccaccgcgcuguacgucgcaggcaugccugaauuaggggccuucuuugcuauccugcaagauaugcggaacacaauuauggccagcaaaaguguuggaaccucugaggaaaagcucaagaaaaaguccgcauucuaucagagcuaccuucgacgcacgcagucgauggguauccaaccagaccagaaaauaauuauccuguacaugucucacuggggcagagaggccgugaaucauuuccacuugggggacgauauggaccccgaacuaagggagcuggcucagacucucguagauaucaaggugcgggagauuuccaaccaggaaccgcugaaacuuuga

SEQ ID NO: 5927 - RNA, 1287 nt, Artificial Sequence
  derived and/or modified CDS sequence (opt3) from SNV(CC107/POR)__KT885046.1__N
augagcacccugaaggaggugcaggacaacaucacacuccacgaacaacagcuugucacuacgagacagaaacugaaggaugccgagagggcuguugaauuggaccccgaugacgugaauaaauccaccuuacagucucggcgcgcagccguaucagcgcuggagacaaagcuaggcgaacucaaacgagagcuggcugaucuuauugccgcacaaaagcuggccaguaagccuguggacccaacugggauagagccggaugaccauuugaaagaaaagagcucccuccguuacggaaacguccuggauguuaauucuaucgaccuggaggaacccucgggucagaccgcugauuggaaaucaauuggccucuauaucuuaaguuucgcacugccuauuauccuuaaggccuuguacaugcugaguacaagagggaggcagaccauaaaagagaacaagggaacucggauccgcuuuaaggacgauuccucuuaugaggaagugaauggcauuagaaaaccaaggcaccuauacgugagcaugcccacagcucaguccaccaugaaggccgacgagaucacgccuggucgguuccgcacuauugcgugcgggcucuuuccagcacaagucaaagcccgaaacaucauaucacccgugaugggaguaauuggcuucagcuuuuucguuaaggacuggauggaaagaaucgaugaguuucuggcugccagguguccuuuccuuccagaacagaaagacccgcgggaugcagcucuggccaccaaucgugcguauuuuauuacacgccagaugcaaguggacgagagcaaggucucugauaucgaggacuugaucgccgaugcaagagcugaauccgccacuauuuucgcugacauagccacaccccauucaguguggguguuugcaugcgccccugauagguguccacccaccgcucucuacgucgcgggcaugccugagcugggggcauucuuugccaucuuacaggacaugcggaacaccauuauggcuagcaaaaguguuggaacgucugaagagaagcugaagaaaaaguccgccuucuaucagagcuaccuccgacgcacucagucgauggguauccaacuugaucagaaaauaauuauccuguacaugucucacuggggcagagaagcagugaaucauuuccacuugggggacgacauggauccagagcuaagggagcuggcccagacacucguagacaucaaggugcgggaaauuuccaaccaggagccccugaaacuuuga

SEQ ID NO: 5928 - RNA, 1287 nt, Artificial Sequence
  derived and/or modified CDS sequence (opt3) from HPS(Convict Creek 107)__L33683.1__N
augagcacccugaaggaggugcaggacaacaucacacuccacgaacaacagcuugucacuacgagacagaaacugaaggaugccgagagggcuguugaauuggaccccgaugacgugaauaaauccaccuuacagucucggcgcgcagccguaucagcgcuggagacaaagcuaggcgaacucaaacgagagcuggcugaucuuauugccgcacaaaagcuggccaguaagccuguggacccaacugggauagagccggaugaccauuugaaagaaaagagcucccuccguuacggaaacguccuggauguuaauucuaucgaccuggaggaacccucgggucagaccgcugauuggaaaucaauuggccucuauaucuuaaguuucgcacugccuauuauccuuaaggccuuguacaugcugaguacaagagggaggcagaccauaaaagagaacaagggaacucggauccgcuuuaaggacgauuccucuuaugaggaagugaauggcauuagaaaaccaaggcaccuauacgugagcaugcccacagcucaguccaccaugaaggccgacgagaucacgccuggucgguuccgcacuauugcgugcgggcucuuuccagcacaagucaaagcccgaaacaucauaucacccgugaugggaguaauuggcuucagcuuuuucguuaaggacuggauggaaagaaucgaugaguuucuggcugccagguguccuuuccuuccagaacagaaagacccgcgggaugcagcucuggccaccaaucgugcguauuuuauuacacgccagaugcaaguggacgagagcaaggucucugauaucgaggacuugaucgccgaugcaagagcugaauccgccacuauuuucgcugacauagccacaccccauucaguguggguguuugcaugcgccccugauagguguccacccaccgcucucuacgucgcgggcaugccugagcugggggcauucuuuggaaucuuacaggacaugcggaacaccauuauggccagcaaaaguguugguacgucugaagagaagcugaagaaaaaguccgcuuucuaucagagcuaccuccgacgcacucagucgaugggcauccaacuugaucagaaaauaauuauccuguacaugucucacugggggagagaagccgugaaucauuuccacuugggagacgacauggauccagagcuaagggagcuggcacagacacucguagacaucaaggugcgggaaauuuccaaccaggagccccugaaacuuuga

SEQ ID NO: 5929 - RNA, 1287 nt, Artificial Sequence
  derived and/or modified CDS sequence (opt3) from HPS(Convict Creek 74)__L33816.1__N
augagcacccugaaggaggugcaggacaacaucacacuccacgaacaacagcuugucacuuccagacagaaacugaaggaugccgagagggcuguugaauuggaccccgaugacgugaauaaaucuacguuacagucacggcgcgcagccguaagugcgcuggagaccaagcuaggcgaacucaaacgagagcuggcugaucauauugccgcacaaaagcuggccagcaagccuguggacccaacagggauagagccggaugaccaccugaaagaaaaguccucuuugcguuacggaaacguccucgaugugaauaguaucgaccuggaggaacccaacggucagacugcugauuggaaaucaauuggccuguauauccucagcuucgcauuaccuauuauccugaaggcccuuuacauguugaguaccagagggaggcagacaauaaaagagaauaagggaacccggauccgcuuuaaggacgauuccucuuaugaggaaguuaacggcauuagaaaaccaaggcaucuguacgugagcaugcccacugcucaguccacaaugaaggccgacgagaucaccccuggucgguuccgcacgauugcgugcgggcuauuuccagcacaagucaaagcccgaaauaucauaucacccgugaugggaguaauuggcuucucguuuuucguuaaggacuggauggaaagaaucgaugaguuucucgcugccagguguccuuuccugccagaacagaaagacccgcgggaugcagcucuugccacuaaccgugcguauuuuauuacccgccagcuucagguggacgagagcaaggucucugauaucgaggacuugaucgccgaugcaagagcugaauccgccacaauuuucgcugacauagccacuccccacucaguguggguguuugcaugcgccccugauagguguccacccaccgcucucuacgucgcgggcaugccugagcugggggcauucuuuggaaucuuacaagacaugcggaauacaauuauggccagcaaaaguguugguaccucugaagagaagcugaagaaaaaguccgcuuucuaucagagcuaccuccgacgcacgcagucgaugggcauccaacuugaucagaaaauaauuauccuguacaugucucauugggggagagaagccgugaaccacuuccacuugggagacgacauggauccagagcuaagggagcuggcacagacucucguagacaucaaggugcgggaaauuuccaaucaggagccccugaaacuuuga

SEQ ID NO: 5930 - RNA, 1287 nt, Artificial Sequence
  derived and/or modified CDS sequence (opt3) from HPS(H-NY1)__U47135.1__N
augagcacccugaaggaggugcaggacaacaucacacuccacgaacaacagcuugucacugccagacagaaacugaaggaugcugagaaagcaguugaaguggaccccgaugacguaaauaaguccacguugcagggcaggcgggccgcggugucugcuuuagagaccaaacugggggaacuaaagcgccaacucgccgaucugauugcagcccagaaacuugcuucaaagccuauagacccaacaggaaucgagccggaugaccaucugaaggagaaaaguagcuugcgauacgguaacguccucgauguuaauuccauugaccuggaagaacccucuggccagacugcagauuggaaggccaucgggauguauauucugucguucgcuaucccuauaauccucaaagccuuauacaugcugucaacccguggaagacagacagugaaggaaaacaagggcaccaggauucgguuuaaagacgauagcaguuaugaggaggugaaugguauccgcaagccaagacaccuuuacgucuccaugcccacugcgcaaucuacaaugaaagcagacgaaauuaccccugggagguuccggacgaucgccugcggauuguuuccagcucaggugaaggcccgcaacauaauuagccccguaaugggcguuaucggcuucaacuuuuucgugaaagacuggauggaucgaauugacgauuuucuggcagagagauguccuuuccuaccagaaccgagggaccccaaggaugcugcccucgggacuaaucgggcguauuuuaucacccgucaggcccaggucgacgaguccaaagugguggauaucgaggagcugauugucgacgcacgcgcugagucagccacacuuuucacugauauagcuaccccucauaguguuuggguguuugccugcgcaccagacagaugucccccuacagcccuguacguagcuggaaugccagaauugggugcguucuuugcaauccuccaagauaugaggaauaccauuauggccagcaagucugugggcacggcugaggaaaagcugaaaaagaaauccgccuucuaucagucauacuuacggcgaacucagagcauggggauccaacuggaccagaagauaauuauccucuacaugauccacuggggaaaagaggcagucaaccauuuccaccuuggcgacgauauggaccccgaacugcgcgaguuggcccaggcucuaguggaugccaagguuaaggagauuaguaaucaggaaccgcugaaacucuga

SEQ ID NO: 5931 - RNA, 1290 nt, Artificial Sequence
  derived and/or modified CDS sequence (opt3) from THAIV(Nakhon Ratchasima/Bi0017/2004)__AM397664.1__N
auggccaccauggaggaacugcagagagagaucaacgcucacgaaggccaacucguggucgcaaggcagaagguuaaagacgccgagaagcaguacgaaaaagaucccgacgaucuuaaucggcgcgcgcugcaugaccgagagagcguggcugccuccauucagucuaagauagaugaguugaaacgucaauuagcagacagaaucgccucagggaggacaauuggacaggaucgggacccuacugguguagaaccaggcgaucaucugcgcgagagaaguaugcuaagcuaugggaacgugcucgaccugaauaaccuugauaucgaggaaccgacgggacagaccgcugacuggcugacaauuaucgucuacuugacuuccuucgugauacccaucauucucaaggcacuguauaugcugaccacaaggggccggcagaccacuaaggauaauaaagguaugcgcauccgauuuaaggacgacucuucguacgaggauguuaacgggauuagaaaaccuaagcaccucuauaucucaaugccaaaugcccaaagcaguaugaaagcugaagagauaacacccggaagguuccggaccgccgugugcggcuuauacccugcgcaggucaaggcacguaacaugguguccccaguaaugucuguuauuggcuuuauggcccuggcuaaggacuggacggaucgcauccaggacuggcuuggggcccccuguaaauucuugccugaucugagcacucagucccuacacgcaucaccaccgaccaaugcugacuauauugcccaaagacagggacuccuggcggguauggaaacaaaggagaguaaaggcaucagggaucaugcccgggacgcagggugcacucuuguggaucaccuggacagccccucuuccaucugggucuuugcuggagccccugaucgauguccaccuaccugcuuguucauugcuggcauggccgaacucggugcauuuuucucaauacugcaggacaugcgcaacacaaucauggccagcaagaccguggggacgagugaggagaaauuaaagaaaaagucuuccuuuuaccaaagcuaccugagaaggacucagucgaugggcauucagcucgaccagcggaucauagugauguucauggucgcuuggggaaaggaagcgguugauaauuuucaccuuggcgacgauauggaccccgagcugcgcaacuuggcacaacuacugauugaucagaaagugaaggaaaucucuaaucaggagccacucaaacuguga

SEQ ID NO: 5932 - RNA, 1290 nt, Artificial Sequence
  derived and/or modified CDS sequence (opt3) from TULV(Tula/Moravia/5302Ma/94)__NC_005227.2__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucacaggguucgcacuggccauaaucuugaaagcucucuacaugcugagcacuaggggacggcagaccauuaaggagaauaaaggcacacgcaucagauuuaaggacgacaguuccuaugaggaaauuaacgguaucaggcggccuaagcaccuguacguuucuaugccaaccgcccagagcacuaugaaagcggaugagcucacacccgggcgcuuccgaaccauagugugcggauuauuuccugcacagauuaugcauagaaauaucauuuccccagucaugggcgugaucggcuucucauuuuucguaaaggacuggcccgagaaaaucgaagaauuucugauuaagccuuguccauuccuuaaaaagagugggccgagcaaagaggaggacuuuuugguuucuaacgaugccuaucugcuaggaagggaaaaggcucuccgggagucccaccuggccgaaauagaugaccuuaucgaucuggcagcuucaggugaccccacgccuccagauagcauuaagaguccccaagccccuuggguguucgcgugccguccagaccgcugucccccgacuugcaucuacauagccggcauggcagaguugggggccuuuuucucuauucuccaggauaugagaaauaccaucauggcuuccaaaacagucggaacugcugaagagaagcugaaaaagaaaagcucguucuaucagucuuacuuaaggcggacccaauccaugggcauccagcuggaccagcgaauuauccuccuuuuuaugacagagugggguucagacauugugaaccauuuccaccugggggaugacauggauccugaauugcgcacccuagcccagagucugauagaccaaaaggugaaggagaucagcaaucaggaaccccucaaaauuuga

SEQ ID NO: 5933 - RNA, 1293 nt, Artificial Sequence
  derived and/or modified CDS sequence (opt3) from TULV(D17-98)__AF289820.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuaugaggaaauuaacgguaucaggcggccuaagcaccuguacgugucuaugccaacagcccagagcaccaugaaagcggaugagcucacucccgggcgcuuccgaacaauagucugcggauuauuuccugcacagauuaugcauagaaauaucauuuccccagugaugggcguaaucggcuucucauuuuucguuaaggacuggcccgauaaaaucgaagaguuucugauuaagccuuguccauuccuuaaaaagcaagggggaccgaacaaagacgaagaguuuuuggugaguuaugaugccuaccugcuagguagggagaaggcucuccgggaaagccaccuggccgagauagacgaucuuaucgaccuggcagcuucuggcgaucccaccccuccagacuccauuaagucaccccaggggccuugggucuucgccugcgcgccagaucguugucccccgacgugcaucuauguggccggaauggcagaauugggcgccuuuuucagcauacuccaggacaugcgcaauacuauuauggcuaguaaaaccguggguacagcugaggaaaagcugaaaaagaaaucuuccuucuaccaaagcuacuuaagaaggacucagucgauggggauccagcuggaccagcggaucauucuccuuuuuaugauggaguggggaucugauaucgucaaccauuuccaccugggcgacgauauggacccugaguugcgaacccuagcccaaucccugauugaucagaagguuaaggaaauaucaaaucaggagccccucaaaaucuga

SEQ ID NO: 5934 - RNA, 1293 nt, Artificial Sequence
  derived and/or modified CDS sequence (opt3) from TULV(D5-98)__AF289819.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuaugaggaaauuaacgguaucaggcggccuaagcaccuguacgugucuaugccaacagcccagagcaccaugaaagcggaugagcucacucccgggcgcuuccgaacaauagucugcggauuauuuccugcacagauuaugcauagaaauaucauuuccccagugaugggcguaaucggcuucucauuuuucguuaaggacuggcccgauaaaaucgaagaguuucugauuaagccuuguccauuccuuaaaaagcaagggggaccgaacaaagacgaagaguuuuuggugaguuaugaugccuaccugcuagguagggagaaggcucuccgggaaagccaccuggccgagauagacgaucuuaucgaccuggcagcuucuggcgaucccaccccuccagacuccauuaagucaccccaggccccuugggucuucgcgugcgccccagaucguugucccccgacgugcaucuauguggcagggauggcugaauugggagccuuuuucagcauacuccaggacaugcgcaauacuauuauggcuaguaaaaccgugggcacagccgaggaaaagcugaaaaagaaaucuuccuucuaccaaagcuacuuaagaaggacucagucgauggguauccagcuggaccagcggaucauucuccuuuuuaugauggagugggggucugauaucgucaaccauuuccaccugggagacgauauggacccugaguugcgaacccuagcacaaucccugauugaucagaagguuaaggaaauaucaaaucaggagccccucaaaaucuga

SEQ ID NO: 5935 - RNA, 1293 nt, Artificial Sequence
  derived and/or modified CDS sequence (opt3) from TULV(D63-98)__AF289821.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuaugaggaaauuaacgguaucaggcggccuaagcaccuguacgugucuaugccaacagcccagagcaccaugaaagcggaugagcucacucccgggcgcuuccgaacaauagucugcggauuauuuccugcacagauuaugcauagaaauaucauuuccccagugaugggcguaaucggcuucucauuuuucguuaaggacuggcccgauaaaaaggaagaguuucugaucaaaccuuguccauuccuuaagaaacaagggggaccgaacaaggacgaagaguuuuuggugaguaaugaugccuaucugcuagguagggagaaggcucuccgggaaagccaccuggccgagauugacgaucuuauagaccuggcagcuucuggcgaucccaccccuccagacuccaucaaaucaccccaggggccuugggucuucgccugcgcgccagaucguugucccccgacgugcauuuacguggccggaauggcagaauugggcgccuuuuucagcauccuccaggacaugcgcaacacuauaauggcuaguaagaccguggguacagcugaggaaaaacugaagaaaaagucuuccuucuaucaaagcuacuuaagaaggacucagucgauggggauucagcuggaccagcggaucauccuccuuuuuaugauggaguggggaucugauauugucaaucauuuccaccugggcgacgauauggacccugaguugcgaacccuagcccaaucccugaucgaucagaagguuaaagaaauuucaaaccaggagccccucaagauauga

SEQ ID NO: 5936 - RNA, 1290 nt, Artificial Sequence
  derived and/or modified CDS sequence (opt3) from TULV(MG23/Omsk)__AF442621.1__N
augagcacccugaaggagauccaggaagagauuacaagacacgaacaacagauagugaucgccaggcagaaacucaaggacgcugagaaaacugucgaagcagaucccgacgauguuaacaagaauacgcuucagucccggcgcgccgcggugucuacccuggaggacaaauuggcugaguucaagcgacaauuagccgaucugguaucaagucagaagaugggcgaaaaaccuguggacccaacagggcuagagccggaugaccaucucaaggaacguagcucccugagauacggaaacguccuugaugugaaugcaacugacauugaugagcccucuggucagaccgccgacugguuuucgaucggccaguauauuaugggguucgcucuggcaaucguuuugaaagcccucuacaugcugucaacaaggggacggcaaaccauaaaggagaacaaaggcacucgcaucaaguuuaaggaugacagcaguauugaagagaucaaugguauuagaaggccuaaacaccuguauguguccaugccaacagcucagucuaccaugaaggccgacgaacucacgcccgggcgguuccgcacuaucgucugcggauuauuuccugcgcagauaaugcaucgaaacauuaucagcccagugaugggcguaauuggcuucuccuuuuucguuaaagauuggcccgacaagaucgaggaauuucugaucaaaccuuguccauuccuuaagaaacaggggucaaccaaggaggaggaauuuuuggugaguaaugaugcauacaugcugggaagagagaaggcccuaagggaaagccaccucgcugagauugacgaacugauagaucuugccgacucuggugauccgacacccccugacuccaucaaaucaccacaagcacccugggucuucgcuugcgccccugaucgguguccacccacuugcauuuauaucgcgggcauggccgagcugggggcauuuuucagcauauugcaggacaugcguaacaccauuauggcuaguaagacagugggaaccgccgaggaaaaacucaagaaaaagucuuccuucuaccagagcuaucugcgcagaacgcaaucgaugggcauccaguuagaucagaggaucauucugcucuuuaugauggagugggguucugacaucgugaaucauuuccaccuuggggacgauauggacccggaacugcggacuuuggcucagucccuaauugaucaaaaggucaaagagauaucaaaccaggaaccucugaagaucuga

SEQ ID NO: 5937 - RNA, 1290 nt, Artificial Sequence
  derived and/or modified CDS sequence (opt3) from TULV(c109-s)__AF164094.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucacaggguucgcacuggccauaaucuugaaagcucucuacaugcugagcacuaggggacggcagaccauuaaggagaauaaaggcacacgcaucagauuuaaggacgacaguuccuaugaggaaauuaacgguaucaggcggccuaagcaccuguacguuucuaugccaaccgcccagagcacuaugaaagcggaugagcucacacccgggcgcuuccgaaccauagugugcggauuauuuccugcacagauuaugcauagaaauaucauuuccccagucaugggcgugaucggcuucucauuuuucguaaaggacuggcccgagaaaaucgaagaauuucugauuaagccuuguccauuccuuaaaaagagugggccgagcaaagaggaggacuuuuugguuucuaacgaugccuaucugcuaggaagggaaaaggcucuccgggagucccaccuggccgaaauagaugaccuuaucgaucuggcagcuucaggugaccccacgccuccagauagcauuaagaguccccaagccccuuggguguucgcgugcgccccagaccguugucccccgacuugcaucuacauagcaggcauggcugaguugggggccuuuuucucuauucuccaggauaugcgcaauaccaucauggcuuccaaaacagucggaacuagcgaagagaagcugaaaaagaaaucgucuuucuaucaguccuacuuaagaaggacccaaucaaugggcauccagcuggaccagcggauuauccuccuuuuuaugacagagugggguagugacauugugaaccauuuccaccugggggaugacauggauccugaauugcgaacccuagcccagagccugauagaccaaaaggugaaggagaucuccaaucaggaaccccucaaaauuuga

SEQ ID NO: 5938 - RNA, 1290 nt, Artificial Sequence
  derived and/or modified CDS sequence (opt3) from TULV(CHEVRU/Hu/FRA/2015/15.00453)__KT946591.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcaggccgcggugucagcucuggaggacaaauuggccgauuucaagcgcaaguuagcagaccugguaaguagccagaaaaugggcgagaagccuguggauccaacggggcuagaaccggacgaucaucucaaagagcgauccucucugcguuacggaaauguccuugacgugaacgccauugauaucgacgaacccucgggucagaccgcugauugguuuucaauuggccaauauguuaugggguucgcacuggccaucauauugaaggcucucuacaugcugagcacaagaggaaggcagacuaucaaagagaauaagggcacccggauucgcuuuaaggacgacaguuccuaugaggaaaucaacgguauuagaaggccuaaacaccuguacgugucuaugccaacagcccagagcaccaugaaggcggaugagcucacucccgggcgguuccgcacaaucgucugcggauuauuuccugcacagauaaugcaucgaaauauuaucuccccagugaugggcguaauuggcuucucauuuuucguuaaagacuggcccgaaaagaucgaggaauuucugaucaaaccuuguccauuccuuaagaaaagugggccgagcaaggaggaggacuuuuuggugucuaacgaugccuaucugcuaggaagagaaaaggcucucagggauucccaccuggccgagauugacgaucuuauagaccuggcagaaucaggugaucccaccccuccagacagcaucaaaaguccccaagcuccuugggucuucgccugcgcgccagaucggugucccccgacgugcauuuacaucgccggcauggcagaguugggggccuuuuucucuauacuccaggacaugcguaauacuauuauggcuuccaagaccgugggaacagcugaagagaaacugaagaaaaagagcucguucuaucagucuuacuuacgcagaacucaauccaugggcauccagcuggaccagaggaucauucuccuuuuuaugaucgagugggguucagauauugugaaccauuuccaccugggggacgauauggacccugaauugcggacccuagcccagagucugauagaucaaaaggucaaagagaucagcaaucaggaaccccucaagauuuga

SEQ ID NO: 5939 - RNA, 1290 nt, Artificial Sequence
  derived and/or modified CDS sequence (opt3) from TULV(g20-s)__AF164093.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcaggccgcggugucagcucuggaggacaaauuggccgauuucaagcgcaaguuagcagaccugguaaguagccagaaaaugggcgagaagccuguggauccaacggggcuagaaccggacgaucaucucaaagagcgauccucucugcguuacggaaauguccuugacgugaacgccauugauaucgacgaacccucgggucagaccgcugauugguuuucaauuggccaauauguuaugggguucgcacuggccaucauauugaaggcucucuacaugcugagcacaagaggaaggcagacuaucaaagagaauaagggcacccggauucgcuuuaaggacgacaguuccuaugaggaaaucaacgguauuagaaggccuaaacaccuguacgugucuaugccaacagcccagagcaccaugaaggcggaugagcucacucccgggcgguuccgcacaaucgucugcggauuauuuccugcacagauaaugcaucgaaauauuaucuccccagugaugggcguaauuggcuucucauuuuucguuaaagacuggcccgaaaagaucgaggaauuucugaucaaaccuuguccauuccuuaagaaaagugggccgagcaaggaggaggacuuuuuggugucuaacgaugccuaucugcuaggaagagaaaaggcucucagggauucccaccuggccgagauugacgaucuuauagaccuggcagaaucaggugaucccaccccuccagacagcaucaaaaguccccaagcuccuugggucuucgccugcgcgccagaucggugucccccgacgugcauuuacaucgccggcauggcagaguugggggccuuuuucucuauacuccaggacaugcguaauacuauuauggcuuccaagaccgugggaacagcugaagagaaacugaagaaaaagagcucguucuaucagucuuacuuacgcagaacucaauccaugggcauccagcuggaccagaggaucauucuccuuuuuaugaccgagugggguucagauaucgugaaccauuuccaccugggggacgauauggacccugaauugcggacacuagcccagagucugauugaucaaaaggucaaagagauaagcaaucaggaaccccucaagaucuga

SEQ ID NO: 5940 - RNA, 1293 nt, Artificial Sequence
  derived and/or modified CDS sequence (opt3) from TULV(Sennickerode Sen05/174)__EU439948.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuucgaggaaauuaacgguaucaggcggccuaagcaccuguaugugucuaugccaacagcccagagcaccaugaaagcggaugagcucacucccgggcgcuuucgaacaauagucugcggauuauucccugcacagauuaugcauagaaauaucauuuccccagugaugggcguaaucggcuuuucauucuuuguuaaggacuggcccgauaaaaucgaagaguuccugauuaagccuuguccauuucuuaaaaagcaagggggaccgaacaaagacgaagauuucuuggugaguaaugacgccuacuuucuggguagggagaaggcucuacgggagagccaccucaacgaaauagaugaccugaucgagcuugccgcaucuggcgaucccaccccuccagacuccauuaagucaccccaggcuccuugggucuucgccugcgcgccagaucguugucccccgacgugcaucuauguggccgggauggcagaacugggagcuuucuuuagcauauugcaggacaugcgcaauacuauuauggccaguaaaaccgugggcacagcugaggaaaagcucaaaaagaaaucuuccuucuaccaaagcuaucugagaaggacucagucgauggguauccaguuagaccagcggaucauucugcucuuuaugauggagugggggucugauaucgucaaccauuuccaccuuggagacgauauggacccugagcugcgaaccuuggcccaaucccuaauugaucagaagguuaaggaaauaucaaaucaggagccccugaaaaucuga

SEQ ID NO: 5941 - RNA, 1293 nt, Artificial Sequence
  derived and/or modified CDS sequence (opt3) from TULV(Sennickerode Sen05/175)__EU439949.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuucgaggaaauuaacgguaucaggcggccuaagcaccuguaugugucuaugccaacagcccagagcaccaugaaagcggaugagcucacucccgggcgcuuucgaacaauagucugcggauuauucccugcacagauuaugcauagaaauaucauuuccccagugaugggcguaaucggcuuuucauucuuuguuaaggacuggcccgauaaaaucgaagaguuccugauuaagccuuguccauuucuuaaaaagcaagggggaccgaacaaagacgaagauuucuuggugaguaaugacgccuacuuucuggguagggagaaggcucuacgggagagccaccucaacgaaauagaugaccugaucgagcuugccgcaucuggcgaucccaccccuccagacuccauuaagucaccccaggcuccuugggucuucgccugcgcgccagaucguugucccccgacgugcaucuauguggccgggauggcagaacugggagcuuucuuuagcauauugcaggacaugcgcaaaaguauuauggccucuaagacugugggcaccgcugaggaaaaacucaagaaaaaguccagcuucuaccaaucguaucugagaaggacacagucuauggguauccaguuagaccagcggaucauucugcucuuuaugauggaguggggguccgauaucgucaaucauuuccaccuuggagacgauauggacccugagcugcgaacuuuggcccaaucacuaauugaucagaagguuaaagaaauaaguaaccaggagccccugaagaucuga

SEQ ID NO: 5942 - RNA, 1293 nt, Artificial Sequence
  derived and/or modified CDS sequence (opt3) from TULV(TUL/Karatal/Ma322/2003)__AM945877.1__N
augagccagcugaaggagauccaagaagagauuaccagacacgaacagcagauagugaucgccaggcagaaacucaaggacgcugagaaaacagucgaagcagaucccgacgauguuaacaagaauacucuucaaucccggcgcgccgcggugucugcucuggaggacaaauuggccgaguucaagcgacaguuagcagaucugguaucaagucagaagaugggcgaaaaaccuguggacccaacggggcuagagccggaugaccaucucaaggaacguagcucccugagauacggaaacguccuugaugugaaugccauugacaucgaugagcccucuggucagaccgcugacugguuuucgauuggccaauauguuaugggguucgcacuggccaucguguugaaagcucucuacaugcugucaacaaggggacggcagacuauaaaggagaacaaaggcacccgcaucagauuuaaggaugacagcaguuucgaagagauuaaugguaucaggcggccuaagcaccuguaugucuccaugccaacagcccagucuaccaugaaagcggacgaacucacucccgggcgcuuucgaacaauugugugcggauuauucccugcacagaucaugcauagaaacauaauuagcccaguaaugggcguuaucggcuuuuccuucuuugugaaggauuggcccgagaaaauugaagaguuccugaucaagccuuguccauuucuuaaaaagcaagggucaaguggaaaagaggaagaguucuuggucagcaaugacgccuaccugaucgguagggaaaagacccuacaggagucucaccucacggaaauugaugaccugauagaucuugcugacuccggcgauccgacucccccugacucaaucaagagcccacaggcccccuggguguuugcaugcgcuccugaucgguguccaccgaccugcauuuauaucgccgggauggcggagcugggagccuucuucaguauauugcaagacaugcguaacacaauuauggcaucuaaaacugugggcaccgcugaggaaaagcucaaaaagaaauccagcuuuuaccagucguaucugcgcagaacacagucuauggguauccaguuagaucaaaggaucauucuccuguucaugauggaguggggguccgacaucgucaaucauuuucaccuuggagacgauauggaccccgaacugcggaccuuggcccagucacuaauugaucagaagguuaaggagauaaguaaccaggaaccucugaaaaucuga

SEQ ID NO: 5943 - RNA, 1293 nt, Artificial Sequence
  derived and/or modified CDS sequence (opt3) from TULV(Tula/Kosice144/Ma/95)__Y13979.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuucgaggaaauuaacgguaucaggcggccuaagcaccuguaugugucuaugccaacagcccagagcaccaugaaagcggaugagcucacucccgggcgcuuucgaacaauagucugcggauuauucccugcacagauuaugcauagaaauaucauuuccccagugaugggcguaaucggcuuuucauucuuuguuaaggacuggcccgagaaaaucgaagaguuccugauuaagccuuguccauuucuuaaaaagcaaggggccccgggaaaagaagaggauuucuuggugaguaacgacgcuuaccugcuagguagggaaaaggcccuccgggagagccaccuggcagaaauagaugaccuuaucgaucuggcugccucuggcgaccccaccccuccagauuccauuaagucaccccaggcgccuugggucuuugccugcgcaccagaccguugucccccgacgugcaucuauauagcugggauggccgaguugggagcuuucuucagcauucuccaggauaugcgcaauacuaucauggccaguaaaaccgugggcacagcagaagagaagcugaaaaagaaaucuuccuuuuaccaaagcuauuuaagaaggacucagucgauggguauccagcuggaccagcggauuauccuccuuuucaugaccgagugggggucugacauugugaaccauuuucaccugggagaugacauggauccugaauugcgaacacuagcccaaucccugauagaccagaaggucaaggagaucucaaaucaggaaccccucaaaauuuga

SEQ ID NO: 5944 - RNA, 1293 nt, Artificial Sequence
  derived and/or modified CDS sequence (opt3) from TULV(Tula/Kosice667/Ma/95)__Y13980.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuucgaggaaauuaacgguaucaggcggccuaagcaccuguaugugucuaugccaacagcccagagcaccaugaaagcggaugagcucacucccgggcgcuuucgaacaauagucugcggauuauucccugcacagauuaugcauagaaauaucauuuccccagugaugggcguaaucggcuuuucauucuuuguuaaggacuggcccgagaaaaucgaagaguuccugauuaagccuuguccauuucuuaaaaagcaaggggccccgggaaaagaagaggauuucuuggugaguaacgacgcuuaccugcuagguagggaaaaggcccuccgggagagccaccuggcagaaauagaugaccuuaucgaucuggcugccucuggcgaccccaccccuccagauuccauuaagucaccccaggcgccuugggucuuugccugcgcaccagaccguugucccccgacgugcaucuauauagcugggauggccgaguugggagcuuucuucagcauucuccaggauaugcgcgacacuaucauggccaguaaaaccgugggcacagcagaagagaagcugaaaaagaaaucuuccuuuuaccaaagcuauuuaagaaggacucagucgauggguauccagcuggaccagcggauuauccuccuuuucaugaccgagugggggucugauauugugaaucauuuucaccugggagacgauauggacccugaauugcgaacacuagcccaaucccugauagaucagaaggucaaggagaucucaaaccaggaaccccucaaaauuuga

SEQ ID NO: 5945 - RNA, 1290 nt, Artificial Sequence
  derived and/or modified CDS sequence (opt3) from TULV(Tula/Koziky/5247Ma/94)__AJ223600.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucacaggguucgcacuggccauaaucuugaaagcucucuacaugcugagcacuaggggacggcagaccauuaaggagaauaaaggcacacgcaucagauuuaaggacgacaguuccuaugaggaaauuaacgguaucaggcggccuaagcaccuguacguuucuaugccaaccgcccagagcacuaugaaagcggaugagcucacacccgggcgcuuccgaaccauagugugcggauuauuuccugcacagauuaugcauagaaauaucauuuccccagucaugggcgugaucggcuucucauuuuucguaaaggacuggcccgagaaaaucgaagaauuucugauuaagccuuguccauuccuuaaaaagaacgggccgaguaaagaggaggacuuuuugguuagcaaugaugccuaucugcuaggaagggaaaaggcucuccgggagucucaccuggccgaaauagaugaccuuaucgaucuggcagcuuccgaggaccccacgccuccagauucaauuaagagcccccaagccccuuggguguucgcgugccguccagaccgcugucccccgacuugcaucuacauagccgguauggcagaauugggcgccuuuuucaguauucuccaggauaugagaaacaccaucauggcuucuaaaacagucgggacugcugaggagaagcugaaaaagaaauccagcuucuaucagucguacuuaaggcggacccaaucuaugggaauccagcuggaccagcgaauuauccuccuuuuuaugacagaauggggcuccgacauugugaaucauuuccaccugggugaugacaugucaccugaguugcgcacccuagcccagagucugauagaucaaaaggugaaggaaaucagcaaccaggagccccucaaaauuuga

SEQ ID NO: 5946 - RNA, 1290 nt, Artificial Sequence
  derived and/or modified CDS sequence (opt3) from TULV(Tula/Moravia/5302v/95)__Z69991.1__N
augagccagcugaaggagauccaagaagagauuaccagacacgaacagcagauagugaucgccaggcagaaacucaaggacgucgagaaaacaguugaagcugaucccgacgaugugaacaaguccacucuucaaucucggcgcgcagccguaucagcgcuggaggacaaauuggcugauuucaagcgacaguuagccgaccuggugaguagccagaagaugggcgagaaaccugucgauccaacggggcuagaaccggacgaucaucucaaggagcguuccucucugagauacggaaaugugcuugacguuaacgcaauugauaucgacgaacccucgggucagaccgccgauugguuuucaauuggccaauauaucacaggguucgcucuggcaauaaucuugaaagcccucuacaugcugagcacuaggggacggcagaccauuaaggagaauaaaggcacacgcaucagauuuaaggacgacaguuccuaugaggaaauuaacgguaucaggcggccuaagcaccuguacgugucuaugccaaccgcucagagcacuaugaaagccgaugagcucacacccgggcgcuuccgaaccauagucugcggauuauuuccugcgcagauuauguauagaaauaucauuuccccagugaugggcguaaucggcuucucauuuuucguuaaggacuggcccgagaaaaucgaagaauuucugauuaagccuuguccauuccuuaaaaagagugggccgagcaaagaggaggacuuuuuggugucuaacgaugcauaccugcuaggaagggaaaaggcccuccgggagucccaucuggcugaaauagaugaccuuaucgaucuggccgcaucaggugaccccacgccuccagauagcauuaagaguccccaagcuccuugggucuucgccugccguccagaccgcugucccccgacuugcaucuauauagcgggcauggccgaguugggggcauuuuucucuauucuccaggauaugagaaauaccaucauggcuuccaaaacagugggaacugccgaagagaagcugaaaaagaaaagcucguucuaccagucuuacuuaaggcggacccaauccaugggcauccagcuggaccagcgaauuauccuccuuuuuaugacagagugggguucagacauugugaaccacuuccaucugggggaugacauggauccugaauugcgcacccuagcucagagucugauagaccaaaaggucaaggagaucagcaaucaggaaccccucaaaauuuga

SEQ ID NO: 5947 - RNA, 1293 nt, Artificial Sequence
  derived and/or modified CDS sequence (opt3) from TULV__AF017659.1__N
augagccagcugaaggagauccaagaagagauuaccagacacgaacagcagauagugaucgccaggcagaaacucaaggacgcugagaaaacagucgaagcagaucccgacgauguuaacaaguccacucuucaaucucggcgcgccgcggugucagcucuggaggacaaauuggccgauuucaagcgacaguuagcagaccugguaaguagccagaagaugggcgagaaaccuguggauccaacggggcuagaaccggacgaucaucucaaggagcguuccucucugagauacggaaauguccuugacgugaacgccauugauaucgacgaacccucgggucagaccgcugauugguuuucaauuggccaauauaucauaggguucgcacuggccaucguuuugaaagcucucuacaugcugagcacaaggggacggcagacuauuaaggagaauaaaggcacccgcaucagauuuaaggacgacaguuccuucgaggaaauuaacgguaucaggcggccuaagcaccuguaugugucuaugccaacagcccagagcaccaugaaagcggaugagcucacucccgggcgcuuucgaacaauagucugcggauuauucccugcacagauuaugcauagaaauaucauuuccccagugaugggcguaaucggcuuuucauucuuuguuaaggacuggcccgagaaaaucgaagaguuccugauuaagccuuguccauuucuuaaaaagcaaggggccccgggaaaagaagaggauuucuuggugaguaacgacgcuuaccugcuagguagggaaaaggcccuccgggagagccaccuggcagaaauagaugaccuuaucgaucuggcugccucuggcgaccccaccccuccagauuccauuaagucaccccaggcgccuugggucuuugccugcgcaccagaccguugucccccgacgugcaucuauguggcugggauggccgaguugggagcuuucuucagcauacuccaggauaugcgcaauacuauuauggccaguaaaaccgugggcacagcagaagagaagcugaaaaagaaaucuuccuuuuaccaaagcuauuuaagaaggacucagucgauggguauccagcuggaccagcggaucauucuccuuuucaugaccgagugggggucugacaucgucaaccauuuucaccugggagaugacauggauccugaauugcgaacacuagcccaaucccugauugaccagaagguuaaggagauaucaaaucaggaaccccucaaaaucuga

SEQ ID NO: 5948 - RNA, 1293 nt, Artificial Sequence
  derived and/or modified CDS sequence (opt3) from TULV(Lodz-1)__AF063892.1__N
augaccgagcugaaggaaauccaggaggaaauuacaagacacgagcaacagauagugaucgccaggcagaaacucaaggacgcugagaaaacugucgaagcagaucccgacgauguuaacaagagcacgcuucagucccggcgcgccgcggugucugcucuggaggacaaauuggccgauuucaagcgacaauuagcagaccugguaucaagucagaagaugggcgaaaaaccuguggauccaaccgggcuagagccggacgaucaucucaaggaacguagcucccugagauacggaaauguccuugacgugaacgccauugauaucgacgagcccucuggucagacagcugauugguuuucgauuggccaguauaucaugggguucgcacuggccauaguuuugaaagcucucuacaugcugucaacuaggggacggcaaaccaucaaggagaauaaaggcacacgcauuagauuuaaggacgacagcaguuaugaagagaucaacgguauuaggcggccuaagcaccuguacguguccaugccaaccgcccagucuacuaugaaagcggaugaacucacacccgggcgcuuccgaaccaucgucugcggauuauuuccugcacagauaaugcauagaaauauuaucagcccagugaugggcguaauuggcuucuccuuuuucguuaaggacuggcccgauaaaaucgaggaauuucugaucaagccuuguccauuccuuaaaaagcaagggggaccgaacaaagacgaggaguuuuuggugucaaaugaugccuaucugcuagguagggaaaaggcucuccgggagagucaccuggccgaaauugacgaucuuauagaccuggcagcuagcggcgaucccacgccuccagacucuaucaagucaccccaggccccuugggucuucgcgugcgccccagaucguugucccccgacuugcauuuacguggcagggauggcugaguugggagccuuuuucuccauccuccaggacaugcgcaacaccauaauggcuagcaaaacagugggcacugccgaagagaagcugaaaaagaaaaguucuuucuaucaguccuacuuaagaaggacccaaagcauggguauucagcuggaccagcggaucauccuccuuuuuaugauggagugggggucggauauugucaaucauuuccaccugggagacgauauggacccugaauugcgaacacuagcacagucucugaucgaucaaaagguuaaggagauuuccaaccaggaaccccucaaaauauga

SEQ ID NO: 5949 - RNA, 1293 nt, Artificial Sequence
  derived and/or modified CDS sequence (opt3) from TULV(Lodz-2)__AF063897.1__N
augaccgagcugaaggaaauccaggaggaaauuacaagacacgagcaacagauagugaucgccaggcagaaacucaaggacgcugagaaaacugucgaagcagaucccgacgauguuaacaagagcacgcuucagucccggugggccgcggugucugcucuggaggacaaauuggccgauuucaagcgccaauuagcagaccugguaucaagucagaagaugggcgaaaaaccuguggauccaaccgggcuagagccggacgaucaucucaaggaacgaagcucccugcguuacggaaauguccuugacgugaacgccauugauaucgacgagcccucuggucagacagcugauugguuuucgauuggccaguauaucaugggguucgcacuggccauaguuuugaaagcucucuacaugcugucaacuagaggaaggcaaaccaucaaggagaauaaaggcacacggauucgcuuuaaggacgacagcaguuaugaagagaucaacgguauuagaaggccuaagcaccuguacguguccaugccaaccgcccagucuacuaugaaagcggaugaacucacacccgggcgguuccgcaccaucgucugcggauuauuuccugcacagauaaugcaucgaaauauuaucagcccagugaugggcguaauuggcuucuccuuuuucguuaaggacuggcccgauaaaaucgaggaauuucugaucaagccuuguccauuccuuaaaaagcaagggggaccgaacaaagacgaggaguuuuuggugucaaaugaugccuaucugcuagguagagaaaaggcucucagggagagucaccuggccgaaauugacgaucuuauagaccuggcagcuagcggcgaucccacgccuccagacucuaucaagucaccccaggccccuugggucuucgcgugcgccccagaucggugucccccgacuugcauuuacguggcagggauggcugaguugggagccuuuuucuccauccuccaggacaugcguaacaccauaauggcuagcaaaacagugggcacugccgaagagaagcugaaaaagaaaaguucuuucuaucaguccuacuuacgcagaacccaaagcauggguauucagcuggaccagaggaucauccuccuuuuuaugauggagugggggucggauauugucaaucauuuccaccugggagacgauauggacccugaauugcggacacuagcacagucucugaucgaucaaaagguuaaggagauuuccaaccaggaaccccucaaaauauga

SEQ ID NO: 5950 - RNA, 1449 nt, Artificial Sequence
  derived and/or modified CDS sequence (opt3) from CCHFV(IbAr10200)__NC_005302.1/U88410.1__N
auggagaacaagaucgaagugaauaacaaagacgagaugaauagaugguucgaagaguuuaagaaaggcaacgggcuggucgauaccuucacaaauagcuacuccuuuugcgaaucuguucccaaccucgacagguucguguuucagauggccucagcuacugaugacgcacaaaaggauaguauuuaugccagcgcgcuuguagaggcuacgaaauucugugccccuauauacgagugcgcauggguguccucuaccggaaucgucaagaagggucuggaaugguuugagaaaaaugccggcacaauuaagucgugggacgaaucauauacugaguugaaaguggauguuccaaagaucgagcaguuaaccggguaccagcaggcugcacugaaauggcggaaggacauuggauuccgcgugaacgccaauacagcugcccuaagcaacaagguccucgcggaauauaaagugccgggcgagaucguaaugaguguuaaggaaaugcuguccgauaugauacgacguagaaaucuuauccugaacagggguggggacgagaauccccggggaccugugucucacgaacaugucgauuggugucgcgaguuugugaaaggcaaguacauuauggcauucaacccacccuggggcgacaucaauaaaagcgggagauccggaauugccuugguggcuaccggucucgccaagcuggcagagacugaaggcaaagggaucuuugaugaggcuaagaagacagucgaagcccugaacggauaucucgacaaacacaaggacgagguugauagggcgucagccgacaguaugauaaccaacuuacugaaacauauugcaaaggcucaagaacuuuacaaaaauagcucugccuugcgggcucaguccgcccagaucgauacggcauucucaagcuacuauuggcuguacaaggccggcgugacuccugagaccuuuccaacaguaagucaguuccuauucgagcucgguaagcaaccccgcgggacuaaaaagaugaaaaaggcucugcuuucuaccccuaugaaauggggaaagaagcuguaugaauuguuugcggacgauuccuuccagcagaaccgaauuuacaugcacccagcagugcucacagccggcagaaucagcgagaugggcgucugcuuugggaccaucccgguggcuaaucccgacgaugccgcacagggaucgggucauacgaaaucuauucugaacuuaaggacuaauacagaaaccaacaauccuugugccaagacuauaguuaaacuguucgaggugcaaaagacaggcuuuaacauccaggacauggauauugucgcuuccgaacaccuccuucaccagucacugguggggaaacaaaguccauuccagaaugccuauaacguaaagggaaaugcaaccagcgcgaacaucauauga

SEQ ID NO: 5951 - RNA, 1449 nt, Artificial Sequence
  derived and/or modified CDS sequence (opt3) from CCHFV(Turkey-Kelkit06)__GQ337053.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaagacucgggcacaauuaagucaugggaugaaaauuaugccgaguugaaagucgacgugccaaagaucgagcaguuagcuaacuaccagcaggcagcccugaaguggagaaaagauauuggguucaggguuaaugcuaacacugccgcgcuaagcaauaaggugcucgcagaauauaaagucccgggagagaucgugaugaguguaaaggaaaugcuguccgacaugauacggcgccgaaaccuuauccugaaucguggcggugaugagaaccccagagggccuguuucuagggaacacguggaguggugucgggaguuugucaaaggaaaguacauuauggccuucaauccacccuggggcgacaucaacaaaagcggccgcuccgggauugcuuugguggccaccggacucgcaaagcuggcugaaacagaggguaagggcguguuugaugaagccaaaaagaccgucgaggcgcugaacggguaucucgacaaacauagagacgaaguugauaaggccucagcagacaguaugaucacuaauuuaccuaaacacauagcuaaggcccaagagcuguacaagaacagcucugcucuuagggcccagggagcacagauugauacaccauucuccucauuuuacugguuguauaaagccggcgugacccccgagacguucccuacuaucagccaguuccuguuugaacuaggugagcaaccacgggggaccaagaaaaugaagaaagcucuccugaguacaccgaugaaguggggaaagaaacuuuacgaacuguucgcggacgauucuuuucagcagaaucgcauuuauaugcaucccgcaguauugacugccggccgaaucuccgagaugggcgugugcuucgggaccaucccugucgcuaacccagacgaugccgcacagggaagcggucacacaaagucgauucucaaucugagaaccucuacggaaacuaacaaucccugugccaaaacaauagugaaguuauuugagauccaagagaccggcuucaacauucaggacauggauaucguugcuuccgaacaucugcuccaccagucaauaguggggaaacaaaguccuuuucagaaugccuacaacgucaagggaaaugcaacuagcgcgaacauuaucuga

SEQ ID NO: 5952 - RNA, 1449 nt, Artificial Sequence
  derived and/or modified CDS sequence (opt3) from CCHFV(Baghdad 12)__AJ538196.1__N
auggagaacaagaucgaagugaauagcaaagacgagaugaacaagugguucgaagaguuuaaaaagggcaaugggcuggucgauaccuacacaaacuccuauucuuucugcgaaucaguucccaaucucgacagauuuguguuccagauggccggagcuacugaugacgcacaaaaagauaguauuuacgccagcgcgcuuguagaggcuacgaaguuuugugccccuauauaugagugcgcaugggccuccucuaccgguaucgugaagaaaggccuggaaugguucgagaagaacacagggacuauuaaaucgugggacgaaucauacaccgaguugaaggucgaggugccaaaaaucgaacaguuauuuaauuaucagcaggcugcacugaaguggaggaaggauauuggauuccggguuaacgccaauacagcugcccuaagcaacaaagugcucgcggaguacaaggucccgggcgaaaucgugaugaguguaaaagagaugcuguccgacaugauacgccgacguaaucuuauccugaacagagguggggaugaaaaucccaggggaccuguuucucgggagcacguggaguggugucgcgaauuugucaagggcaaauauauuauggcauucaacccacccuggggcgacaucaauaagagcgggagauccggaauugccuugguggcuaccggucucgccaaacuggcagagacugaaggcaaggggguguuugaugaggcuaagaaaacagucgaagcccugaacggauaccucgacaagcauaaagaugagguugacaaggcgucagccgacaacauggugaccaauuuacugaaacacguagcaaaggcucaagagcuuuacaagaacaguagcgccuugagggcucagggcgcccagaucgauacgguguucucuuccuauuacuggcuguauaaagccggugucacuccugaaaccuuuccaacagugucacaguuccuauucgagcucgggaagcauccccggggaacuaaaaagaugaaaaaggcacugcuuagcaccccuaugaaguggggcaaaaagcuguacgaauuguuugcugacgauaguuuccaacagaaucgcauauauaugcacccagcgguucucacagcaggccgaauuucugagaugggggugugcuuuggaaccaucccggucgccaaccccgacgaugcugcccuggguuccggccauacgaaaagcauuuuaaaucugagaacuaacacagaaaccaauaacccuugugcaaggacuaucgugaaacucuucgagauccagaagacaggguuuaauauucagcacauggacauaguagccucggagcaccuucugcaucaaucuuugguuggaaagcaguccccauuccagaacgcuuacaaugugaagggcaacgccaccucagcaaauaucauuuga

SEQ ID NO: 5953 - RNA, 1449 nt, Artificial Sequence
  derived and/or modified CDS sequence (opt3) from CCHFV(SR3)__AJ538198.1__N
auggagaacaagaucgaagugaauagcaaagacgagaugaacaagugguucgaagaguuuaaaaagggcaaugggcuggucgauaccuucacaaacuccuacucuuuuugcgaaucaguucccaaucucgacagauucguguuucagauggccagugcuacugaugacgcacaaaaagauagcauuuaugccuccgcgcuuguagaggcuacgaaguucugugccccuauauacgagugcgcaugggccucuucgaccggaaucgugaagaaaggucuggaaugguuugagaagaacgcuggcacaauuaaaucaugggacgaaagcuauacugaguugaaggucgaggugccaaaaaucgaacaguuaaguaauuaccagcaggcagcccugaaguggaggaaggauauuggguuccggguuaacgcuaauaccgccgcgcuauccaacaaagugcucgcagaguauaaggucccgggagaaaucgugaugucuguaaaagagaugcugagcgacaugauacgccgacguaaucuuauccugaacagaggcggugaugaaaaucccagggggccuguuucccgggagcacguggaguggugucgcgaauuugucaagggaaaauacauuauggccuucaacccacccuggggcgacaucaauaagucaggcagaagugggauugcuuugguggccacaggacucgcaaaacuggcugagaccgaagguaagggcguguuugaugaggccaagaaaacugucgaagcgcugaacggguaucucgacaagcauaaagaugagguugacaaggccagcgcagacucuaugaucacaaacuuacugaaacacauagcuaaggcccaagagcuuuacaaaaauuccucagcuuugagggcccagggagcacagauugauaccguguucagcaguuacuauuggcuguacaaagccggcguaacgccugacacuuuuccagcugugucucaguuccuauucgaacucgguaagcaaccccgggggaccaaaaagaugaaaaaggcgcugcuuuccacaccuaugaaguggggaaagaagcuguaugaguuguuugcagaugacagcuuccagcagaaccgcaucuacaugcauccagccguccucacugcuggccgaauuucggaaaugggcgugugcuuugggaccaucccgguugccaaucccgaugacgcagcccugggaucuggucacacaaaauccaucuuaaaccugagaaccaauacggagacuaacaauccuugugcuaagacaauugugaaacucuucgaaauacagaagaccggcuuuaacauccaagauauggacauugucgccucagagcaucuucugcaccagaguuugguggggaagcagagcccauuccaaaaugcauauaacguaaaaggaaaugcgacuuccgcuaacaucauauga

SEQ ID NO: 5954 - RNA, 1449 nt, Artificial Sequence
  derived and/or modified CDS sequence (opt3) from CCHFV(Gaib)__KX013446.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagaaaucguaaugaguguuaaagagaugcuguccgacaugauacgccgacguaaucuuauccugaacagaggcggugaugaaaaucccagggggccugugucucgggagcaugucgaguggugucgcgaauuugugaagggaaaauacauuauggccuucaacccacccuggggcgacaucaauaagagcggcagauccgggauugcuuugguggccacaggacucgcaaaacuggcugagaccgaagguaagggcgucuuugaugaggccaagaaaacuguugaagcgcugaacggguaucucgacaagcacaaagaugagguggacaaggccucagcagacaacaugaucacaaauuuacugaaacauauagcuaaggcccaagagcuuuacaagaacaguagcgcuuugagggcccagggagcacagauugauaccgccuucucuuccuacuauuggcuguacaaagcuggcguaacgccugaaacuuuuccaaccgugucacaguuccuauucgagcucgguaagcaaccccgggggacuaaaaagaugaaaaaggcgcugcuuagcacaccuaugaaguggggcaaaaagcuguaugaauuguuugcagacgauaguuuccagcagaaucgcaucuacaugcacccagccguccucaccgcuggacgaauuucugagaugggcgugugcuuugggacaaucccgguugccaaccccgacgaugcagcccagggauccggucauaccaaaagcauccugaauuuaagaacgaacacugaaacaaauaacccuugugcuaagaccauugugaaacuguucgagauacaaaagacuggcuuuaauauccaggacauggauauugucgccucggagcaccuccuucaccagucucugguggggaagcaauccccauuccagaacgcauauaauguaaaaggaaacgcgacaucagcuaauaucauauga

SEQ ID NO: 5955 - RNA, 1449 nt, Artificial Sequence
  derived and/or modified CDS sequence (opt3) from CCHFV(Hodzha)__KX013449.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguucugugugaaugcuaacaccgccgcgcuaagccaaaaaguccucagugaguauaaggugccgggagaaaucguaauguccguuaaagagaugcugucugacaugauacggcgccgaaaucuuauccugaaccguggcggugaugaaaaucccagagggccugugagcagggagcacgucgaguggugccgggaauuugugaagggaaaauacauuauggcauucaacccacccuggggcgacaucaauaaguccggccgcucagggauugccuugguggcuacaggacucgccaaacuggcagagaccgaagguaagggcgucuuugaugaggcuaagaaaacuguugaagcccugaacggguaucucgacaagcauaaagaugagguggacaaggcgagugccgacaacaugacaaccaauuuacugaaacacaucgcaaaggcucaggagcuuuacaagaacagcucugccuugagagcucagggagcccagauagauacggcauucuccucauacuauuggcuguacaaagccggcguaacuccugaaaccuuuccaacagugagccaauuccuauucgagcucgguaagcagcccagggggacuaaaaagaugaaaaaggcucugcuuaguaccccuaugaaguggggcaaaaagcuguaugaauuguuugcggacgauucuuuccagcagaaucggauuuacaugcauccagcaguccucacaaccggacgcaucuccgagaugggcguguguuuugggacgguuccgguggccgaccccgaugacgcugcccaaggaagcggucacacuaaaucgauucugaacuuacgaacaaauaccgaaacuaacaauccuugcgcaaagacaaucgucaaacuguucgagauccagaagaccggcuuuaacauucaggauauggacauaguggccucugagcaucuccuucaccaaucccugguagggaagcagucaccauuccagaaugcuuauaacguuaaaggaaaugccacgagugcaaacaucauuuga

SEQ ID NO: 5956 - RNA, 1449 nt, Artificial Sequence
  derived and/or modified CDS sequence (opt3) from CCHFV(IbAn7620)__KX013452.1__N
auggagaacaagaucgaagugaauaacaaagacgagaugaauagaugguucgaagaguuuaagaaagaaaacggccuggucgauaccuucacaaauagccacuccuuuugcgagucuguucccaaccucgacaaguucguguuucagauggccucagcuacugaugacgcacaaaaagauaguauuuacgccgcggcucuuguagaggccacgaaguucugugcaccuauauaugaaugcgccugggugagcuccaccgggaucgucaagaaaggacuggagugguuugaaaagaaugcugguacaauuaaaucuugggacgagucguacacugaguugaagguggaaguuccaaaaaucgagcaguuaucaaacuaucagcaggcagcccugaaguggaggaaggauauuggcuuccgggugaaugcuaacaccgccacacuaagccauaaaguccucgcggaauacaaggugccgggggagaucguaaugaguguuaaagaaaugcuguccgacaugauacgccgacguaaucuuauccugaacagaggaggcgaugagaaucccagggguccugugucucgggagcacgucgaauggugucgcgaguuugugaaggggaaauauauuauggcauucaacccacccuggggagacaucaauaagagcggcagauccggcauugccuugguggcuaccgggcucgccaaacuggcagaagcugagggaaagggugucuuugaugaagccaagaaaacuguugaggcgcugaacggcuaccucgacaagcauaaagaugagguggacaagucaagugccgacagcaugaucacaaacuuacugaaacacauagcaaaggcucaagaacuuuauaaaaauucuuccgccuugagggcucagggggcccagauugauaccgcauucucaagcuacuacuggcuguauaaagccggaguaacgccugagacuuuuccaaccgugagucaguuccuauucgaacucggcaagcaaccccgggguacaaagaagaugaaaaaggcucugcuuucuacuccuaugaagugggggaaaaagcuguacgaguuguuugcggacgauuccuuccagcagaaccgcaucuauaugcauccagcaguccucaccgccggacgaauuagcgaaaugggcgugugcuuuggcacaaucccgguugcuaaucccgacgaugccgcacuggggucgggacacaccaaaucuaucuuaaaccugagaacguccacugaggccaauaacccuugugcuaagacaauugugaaacucuucgagauacagaagaaggguuuugucaucaaagacauggauauuguggccucagaacaccuucugcaucaaaguuugguaggcaagcagagcccauuccagaaugcauacaacguuaaagggaaugcgaccuccgcuaacaucauauga

SEQ ID NO: 5957 - RNA, 1449 nt, Artificial Sequence
  derived and/or modified CDS sequence (opt3) from CCHFV(K128_76)__KX013455.1__N
auggagaacaagaucgaagugaauaacaaagacgagaugaauaagugguucgaagaguuuaaaaagggcaacgggcuggucgauaccuucacaaauagcuacuccuuuugcgaaucuguucccucacucgacagauucguguuucagauggccagugcuacugaugacgcacaaaaagauagcauuuaugccuccgcgcuuguagaggcuacgaaguucugugccccuauauacgagugcgcaugggugucuucgaccggaaucgucaagaaaggucuggaaugguuugagaagaacgccggcacaauuaaaucaugggacgaaagcuauacugaguugaagguggagguuccaaaaaucgaacaguuagcuaauuaccagcaggcagcccugaaguggaggaaggauauuggguuccgggugaacgcuaauaccgccgcgcuaagucacaaaguccucgcagaguauaaggugccgggagaaaucguaauguccguuaaagagaugcugucugacaugauacgccgacguaaccuuauccugaauagaggcggugaugaaaaccccagggggccugugagccgggagcaugucgaguggugucgcgaauuugugaagggaaaauacauuauggccuucaauccacccuggggcgacaucaacaaguccggcagaucagggauugcuuugguggccacaggacucgcaaaacuggcugagaccgaagguaagggcgucuuugaugaggccaagaaaacuguugaagcgcugaauggguaucucgacaagcacaaagaugagguggacaaggccagugcagacaacaugaucacaaacuuacugaaacauauagcuaaggcccaagagcuuuacaagaauagcucugcuuugagggcccagggagcacagauugauaccgccuucuccucauacuauuggcuguacaaagcuggcguaacgccugaaacuuuuccaaccgugagccaguuccuauucgagcucgguaagcaaccccgggggacuaaaaagaugaaaaaggcgcugcuuaguacaccuaugaaguggggcaaaaagcuguaugaauuguuugcagacgauucuuuccagcagaaccgcaucuacaugcacccagccguccucaccgcuggacgaauuuccgagaugggcgugugcuuugggacaaucccgguugccaaucccgacgaugcagcccagggaagcggucauaccaaaucgauccugaacuuaagaacgaauacugaaacaaacaauccuugugcuaagaccauugugaaacuguucgagauacaaaagacuggcuuuaacauccaggacauggauauugucgccucugagcaccuccuucaccagucccugguggggaagcaaucaccauuccagaaugcauauaacguaaaaggaaaugcgacaagugcuaacaucauauga

SEQ ID NO: 5958 - RNA, 1449 nt, Artificial Sequence
  derived and/or modified CDS sequence (opt3) from CCHFV(K168_125)__KX013461.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagacaucguaaugaguguuaaagaaaugcuguccgauaugauacgccgacguaaucuuauccugaacagaggcggugacgagaaucccagggggccugugucucgggaacaugucgaguggugucgcgaguuugugaagggaaaauacauuauggccuucaacccacccuggggcgauaucaauaagagcggcagauccgggauugcuuugguggccacaggacucgcaaaacuggcugaaaccgaggguaagggcgucuuugacgaagccaagaaaacuguugaggcgcugaacggguaucucgauaagcacaaagacgaaguggacaaggccucagcagauaacaugaucacaaauuuacugaaacauauagcuaaggcccaagagcuuuacaagaacaguagcgcuuugagggcccagggagcacagauugacaccgccuucucuuccuacuauuggcuguacaaagcuggcguaacgucagagacuuuuccuaccgugagccaguuccuauucgaacucgguaagcaaccacgggggacuaaaaagaugaaaaaggcgcugcuuaguacacccaugaaguggggcaaaaagcuguaugaguuguuugcagaugacucuuuccagcagaaucgcaucuacaugcacccugccguccucaccgcuggacgaauuuccgaaaugggcgugugcuuugggacaaucccaguugccaacccggaugacgcagcccagggaagcggucauaccaaaucgauccugaauuuaagaacgaacacugagacaaauaaccccugugcuaagaccauugugaaacuguucgaaauacaaaagacuggcuuuaauauccaggauauggacauugucgccucugagcaccuccuucaccagucccugguggggaagcaaucaccuuuccagaacgcauauaauguaaaaggaaacgcgacaagugcuaauaucauauga

SEQ ID NO: 5959 - RNA, 1449 nt, Artificial Sequence
  derived and/or modified CDS sequence (opt3) from CCHFV(K168_40)__KX013458.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagacaucguaaugaguguuaaagaaaugcuguccgauaugauacgccgacguaaucuuauccugaacagaggcggugacgagaaucccagggggccugugucucgggaacaugucgaguggugucgcgaguuugugaagggaaacuacauuauggccuucaauccacccuggggcgauaucaacaaaagcggcagauccgggauugcuuugguggccacaggacucgcaaagcuggcugaaaccgaggguaaaggcgucuuugacgaagccaagaagacuguugaggcgcugaacggguaucucgauaaacacaaggacgaaguggacaaagccucagcagauaauaugaucacaaacuuacugaagcauauagcuaaagcccaagagcuuuacaagaauaguagcgcuuugagggcccagggagcacagauugacaccgccuucucuuccuacuauuggcuguacaaggcuggcguaacgucagagacuuuuccuaccgugagccaguuccuauucgaacucgguaaacaaccacgggggacaaagaaaaugaagaaagcgcugcuuaguacucccaugaaguggggaaagaaacuguaugaguuguuugcagaugacucuuuccagcagaaccgcaucuacaugcacccugccguccucaccgcuggccgaauuuccgaaaugggcgugugcuuugggacaaucccaguugccaauccggaugacgcagcccagggaagcggucauaccaagucgauccugaacuuaagaacgaauacugagacaaacaaucccugugcuaaaaccauugugaagcuguucgaaauacagaaaacuggcuuuaacauccaagauauggacauugucgccucugagcaccuccuucaccagucccugguggggaagcaaucaccuuuccagaaugcauauaacguaaagggaaaugcgacaagugcuaacaucauauga

SEQ ID NO: 5960 - RNA, 1449 nt, Artificial Sequence
  derived and/or modified CDS sequence (opt3) from CCHFV(K323_27)__KX013473.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaagcggccgcuccgggauugcuuugguggccaccggacucgcaaagcuggcugaaacagaggguaagggcguguuugacgaagccaaaaagaccgucgaggcgcugaauggguaucucgauaaacauagagacgaaguugacaaggccucagcagauaguaugaucacuaacuuacugaaacacauagcuaaggcccaagagcuuuacaagaauagcucugcuuugagggcccagggagcacagauugacacaccuuucuccucauuuuacuggcuguauaaagccggcgugaccccagagacguuccccacuaucagccaguuccuauuugaacucgguaagcaaccucgggggaccaaaaagaugaaaaaggcucugcuuaguacaccaaugaaguggggcaaaaagcuguacgaguuguucgcggaugacucuuuucagcagaaccgcauuuauaugcauccggcaguacucacugccggacgaaucuccgaaaugggcgugugcuucgggaccauccccgucgcuaauccugaugacgccgcacagggaagcggucacacaaaaucgauucugaacuuaagaaccucuacggagacuaauaacccaugugccaagacaauagugaaacuguuugaaauccaaaagaccggcuucaauauucaggauauggacaucguugcuuccgagcaucuccuucaccagucacugguggggaagcaaagucccuuucagaacgccuucaaugucaaaggaaacgcaacuagcgcgaauauaauuuga

SEQ ID NO: 5961 - RNA, 1449 nt, Artificial Sequence
  derived and/or modified CDS sequence (opt3) from CCHFV(Min)__KX013482.1__N
auggagaacaagaucgaagugaauagcaaagacgagaugaacaagugguucgaagaguuuaaaaagggcaaugggcugauggauacuuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaauugggccgcagcgggauugcucucguggccaccggacuggcaaagcuggcugaaacagaggguaagggcguguuugacgaagccaaaaagaccgucgaggcgcucaauggguauuuagauaaacauagagacgaaguugacaaggccuccgcagauucaaugaucacuaaccugcuuaaacacauagcuaaggcccaagaguuguacaagaauaguagcgcucugagggcccagggagcacagauugacacaccuuucucuuccuuuuacuggcuauauaaagccggcgugaccccagagacguuccccacuaucucacaguuccucuuugaacuggguaagcaaccucgggggaccaaaaagaugaaaaaggcucuccugagcacaccaaugaaguggggcaaaaaguuguacgagcuuuucgcggaugacaguuuucagcagaaccgcauuuauaugcauccggcaguacugacugccggacgaaucucugaaaugggcgugugcuucgggaccauccccgucgcuaauccugaugacgccgcacagggauccggucacacaaaaagcauuuuaaaccugagaaccucgacggagacuaauaacccaugugccaagacaauagugaaacucuuugaaauccaaaagaccggcuucaauauucaggauauggacaucguugcuucugagcaucuucugcaccaguccuugguggggaagcaaucacccuuucagaacgccuacaaugucaaaggaaacgcaaccagugcgaauauaauuuga

SEQ ID NO: 5962 - RNA, 1449 nt, Artificial Sequence
  derived and/or modified CDS sequence (opt3) from CCHFV(Saf)__KX013488.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaagcggccgcuccgggauugcuuugguggccaccggacucgcaaagcuggcugaaacagaggguaagggcguguuugacgaagccaaaaagaccgucgaggcgcugaauggguaucucgauaaacauagagacgaaguugacaaggccucagcagauaguaugaucacuaacuuacugaaacacauagcuaaggcccaagagcuuuacaagaauagcucugcuuugagggcccagggagcacagauugacacaccuuucuccucauuuuacuggcuguauaaagccggcgugaccccagagacguuccccacuaucagccaguuccuauuugaacucgguaagcaaccucgggggaccaaaaagaugaaaaaggcucugcuuaguacaccaaugaaguggggcaaaaagcuguacgaguuguucgcggaugacucuuuucagcagaaccgcauuuauaugcauccggcaguacucacugccggacgaaucuccgaaaugggcgugugcuucgggaccauccccgucgcugauccugacgaugccgcacagggaagcggucacacaaaaucgauucugaauuuaagaaccucuacggagacuaacaauccaugugccaggacaauagugaagcuguuugaaauccagaaaaccggcuucaacauucaagacauggauaucguugcuuccgagcaucuccuucaccagucacugguggggaagcaaagucccuuucagaaugccuacaacgucaagggaaaugcaacuagcgcgaacauaauuuga

SEQ ID NO: 5963 - RNA, 1449 nt, Artificial Sequence
  derived and/or modified CDS sequence (opt3) from CCHFV(UCCR4459)__KY484031.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuggguaccagcaggcagcccugaaguggaggaaggauauuggauuccgggugaacgcuaauaccgccgcgcuaagccacaaaguccucgcagaguauaaggugccgggcgaaaucguaaugaguguuaaagagaugcuguccgacaugauacgccgacguaaccuuauccugaauagagguggggaugaaaaccccaggggaccugugucucgggagcaugucgaguggugucgcgaauuugugaagggcaaauacauuauggccuucaauccacccuggggcgacaucaacaaguuggggagaagcggaauugcucucguggccacaggucuggcaaaacuggcugagaccgaaggcaagggggucuuugaugaggccaagaaaacuguugaagcgcucaauggauauuuagacaagcacaaagaugagguggacaaggccuccgcagacaacaugaucacaaaccugcuuaaacauauagcuaaggcccaagaguuguacaaaaauucaagugcucugagggcccagggcgcacagauugauaccgccuucagcucuuacuauuggcuauacaaagcugguguaacgccugaaacuuuuccaaccgugucccaguuccucuucgagcuggggaagcaaccccggggaacaaagaagaugaaaaaggcgcuucugucaacuccuaugaaguggggcaaaaaguuguaugaacucuuugcagacgauagcuuccagcagaaccgcaucuacaugcacccagccguccugaccgcuggccgaauuagugagaugggggugugcuuuggaacaaucccgguugccaaucccgacgaugcagcccaggguucuggccauaccaaauccaucuuaaaccugagaacgaauacugaaacaaacaauccuugugcuaagaccauugugaaacucuucgagauacaaaagacuggguuuaacauccaggacauggauauugucgccagcgagcaccuucugcaccagucguuggugggaaagcaaucuccauuccagaaugcauauaacguaaaaggcaaugcgacauccgcuaacaucauauga

SEQ ID NO: 5964 - RNA, 1449 nt, Artificial Sequence
  derived and/or modified CDS sequence (opt3) from CCHFV(YL16070)__KY354080.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcugauuaccagcaggcagcccugaaguggaggaaggacauuggguuccgggugaacgcuaauaccacagcccuaagccacaaaguccucgcggaguauaaggugccgggagaaaucguaaugaguguuaaagagaugcuguccgauaugauacgccgacguaaccuuauccugaauagaggcggugacgaaaaccccagggggccugugucucgggagcaugucgaguggugucgcgaauuugugaagggaaaauacauuauggcauucaauccacccuggggcgauaucaacaagagcggcagauccgggauugccuugguggcuaccggacucgccaaacuggcagagacugaagguaagggcgucuuugacgaggcuaagaaaacaguugaagcccugaauggguaucucaacaagcacaaagaugagguggacaaggcgucagccgacaguaugaucaccaacuuacugaaacauauagcaaaggcucaagagcuuuacaagaauagcucugccuugagggcucagggagcccagauugauacggcauucuccucauacuauuggcuguacaaagccggcguaacuccugaaaccuuuccaacagugagccaguuccuauucgagcucgguaagcaaccccgggggacuaaaaagaugaaaaaggcucugcuuaguaccccucugaaguggggaaaacgcuuguaugaacucuuugcggacgauucuuuccagcagaaccgaaucuacaugcacccagcaguccugacagccggcagaauuuccgagaugggcgugugcuuugggaccaucccgguugcuaaucccgacgaugccgcacagggaagcggucauacgaagucgaucuuaaaccugaggacuaauacagaaaccaacaauccuugugccaaaacuauugugaaacucuucgagauacaaaagacaggcuuuaacauccaggacauggauauugucgcuucugagcaccuucugcaccaguccuugguggggaagcaaucaccauuccagaaugccuauaacguaaagggaaaugcaaccagugcgaacaucauauga

SEQ ID NO: 5965 - RNA, 1449 nt, Artificial Sequence
  derived and/or modified CDS sequence (opt3) from CCHFV(66019)__AJ010648.1__N
auggagaacaagaucgaagugaauaacaaagacgagaugaauagaugguucgaagaguuuaagaaaggcaacgggcuggucgauaccuucacaaauagcuacuccuuuugcgaaucuguucccaaccucgacagguucguguuucagauggccucagcuacugaugacgcacaaaaggauaguauuuaugccagcgcgcuuguagaggcuacgaaauucugugccccuauauacgagugcgcauggguguccucuaccggaaucgucaagaagggucuggaaugguuugagaaaaaugccggcacaauuaagucgugggacgaaucauauacugaguugaaaguggagguuccaaagaucgaacaguuagcuagcuaccagcaggcagcccugaaauggcggaaggauauuggguuccgcgugaacgcuaauaccgccgcgcuaagucacaagguccucgcagaguauaaagugccgggagaaaucguaauguccguuaaggagaugcugucugacaugauacgacguagaaaccuuauccugaauaggggcggugaugaaaacccccgggggccugugagccgcgagcaugucgagugguguagagaauuugugaaaggaaaguacauuauggccuucaauccacccuggggcgacaucaacaaauccggcaggucagggauugcuuugguggccacaggacucgcaaagcuggcugagaccgaagguaaaggcgucuuugaugaggccaagaagacuguugaagcgcugaauggguaucucgacaaacacaaggaugagguggacaaagccagugcagacaacaugacaaccaacuuacugaagcauaucgcuaaagcccaagagcuuuacaagaauagcucugcuuugcgggcccagggagcacagauagauacggccuucuccucauacuauuggcuguacaaggcuggcguaacuccugaaaccuuuccaacagugagccaguuccuauucgagcucgguaaacaaccccgcgggacuaagaaaaugaagaaagcgcugcuuaguaccccuaugaaguggggaaagaaacuguaugaauuguuugcagacgauucuuuccagcagaaccgaauuuacaugcacccagccguccucacagcuggcagaaucuccgagaugggcgugugcuuugggaccauuccgguugccgaccccgaugacgcagcccagggaagcggucauacgaagucgauccugaauuuaaggacuaacacagaaaccaauaacccuugugcuaaaacuaucgugaagcuguucgagauucagaaaacaggcuuuaauauacaagauauggacaucgucgccucugagcaccuccuucaccagucccugguggggaagcaaucaccauuccagaacgcauauaauguaaagggaaacgcgaccagugcuaauauuaucuga

SEQ ID NO: 5966 - RNA, 1449 nt, Artificial Sequence
  derived and/or modified CDS sequence (opt3) from CCHFV(8402)__AJ010649.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccucagcuacugacgaugcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauacugaguugaagguggaaguuccaaaaaucgagcaguuagcuaacuaccagcaggcagcccugaaguggaggaaggacauuggguuccgggugaaugcuaacaccgccgcgcuaagccacaaaguccucgcagaauauaaggugccgggagagaucguaaugaguguuaaagaaaugcuguccgauaugauacgccgacguaaucuuauccugaacagaggcggugacgagaaucccagggggccugugucucgggagcaugucgaauggugucgcgaguuugugaagggaaaauacauuauggccuucaacccacccuggggcgauaucaauaagagcggcagauccgggauugcuuugguggccacaggacucgcaaaacuggcugaaaccgaggguaagggcgucuuugacgaagccaagaaaacuguugaggcgcugaacggguaucucgauaagcacaaagacgagguggauaaggccucagcagacaacaugaucacaaauuuauucaaacauauagcuaaggcccaagaacuguacaagaaccuuagugcuuugggagcccagggcgcacagauugacaccgccuuuagcucuuacuauuggcuguacaaagcugguguaacgccugagacuuucccaaccgugucccaguuccuauuugaacucgggaagcaacccaggggaacuaaaaagaugaaaaaggcgcugcuuucaacaccuaugaaguggggcaaaaagcuguaugaguuguucgcagaugacagcuuucagcagaaucggaucuacaugcacccagccguccucaccgcuggccgcauuagugaaaugggggugugcuucggaacaaucccgguugccaaccccgaugacgcagcccaggguucuggccauaccaaauccauccugaauuuacgaacgaacacugagacaaauaacccuugugcuaagaccauugugaaacuguuugagauacaaaagacuggguucaauauccaggauauggacauugucgccagcgaacaccuccuucaccagucgcuggugggaaagcaaucuccauuucagaacgcauauaauguaaaaggcaacgcgacauccgcuaauaucauauga

SEQ ID NO: 5967 - RNA, 1449 nt, Artificial Sequence
  derived and/or modified CDS sequence (opt3) from CCHFV(Bul/HU517)__AY277676.2__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcgccauuaagucaugggacgaaaacuaugucgaguugaaaguggauguuccaaagaucgagcaguuagcuaauuaccagcaggcagcccugaaguggagaaaagacauuggguucagggugaacgcuaauacagccgcgcuaagcaacaagguccucgcagaauauaaagugccgggagagaucguaaugaguguuaaggaaaugcuguccgauaugauacggcgccgaaaucuuauccugaaccguggcucugacgagaaucccagagguccugugagccacgaacaugucgagugguguagggaguuugugaaagggaaguacauuauggccuucaacccacccuggggagauaucaacaaauccggccggucaggcauugcuuugguggccacugggcucgcaaagcuggcugaaaccgagggaaagggugucuuugacgaagccaaaaagacaguugaggcgcugaauggcuaucucgauaaacaccgcgacgaaguggacaaggccagugcagauagcaugaucaccaacuuacugaaacauauagcuaaggcccaagagcuuuacaagaauagcuccgcuuugagagcccagggggcacagauugacacuccuuucucaucuuuuuacuggcuguauaaagccggaguaacaccagagaccuuccccacgaucagucaguuccuauuugaacucggcaagcaaccuagggguacuaaaaagaugaaaaaggcucugcuuucuaccccaaugaagugggggaaaaagcuguacgaguuguucgcggaugacuccuuucagcagaaccggauuuauaugcacccggcagugcucacagccggacgcaucagcgaaaugggcgucugcuucggcacuauccccguggcuaauccugaugacgccgcacaggggucgggacauaccaaaucuauucugaacuuacgaacauccaccgagacgaauaacccaugugccaagacuauaguuaaacuguuugaaauccaaaagacagguuucaauauucaggauauggacaucguggcuucagagcaccuccuucaccagagucuggucggcaagcaaagccccuuucagaacgccuacaaugugaaagggaacgcaaccuccgcgaauauaauuuga

SEQ ID NO: 5968 - RNA, 1449 nt, Artificial Sequence
  derived and/or modified CDS sequence (opt3) from CCHFV(V46/13)__KR011837.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcucugacgagaaucccagagguccuguuagcagggaacacguggaguggugucgggaguuugucaaagggaaguacauuauggccuucaacccacccuggggagauaucaacaaauccggccgcucaggcauugcuuugguggccaccgggcucgcaaagcuggcugaaacagagggaaaggguguguuugacgaagccaaaaaggcggucgaggcccugaauggcuaucucgauaaacauagagacgaaguugugaaggcaagugcugacagcaugaucaccaacuuacugaaacacauagccaaggcucaagagcuuuacaagaauagcuccgccuugagggcacagggggcccagauugauacuccuuucucaucuuuuuacuggcuguauaaagcuggaguaacaccagagaccuuccccacgaucagucaguuccuauuugaacucggcaagcaaccucgggguacuaaaaagaugaaaaaggcgcugcuuucuaccccaaugaagugggggaaaaagcuguacgaguuguucgcagacgauuccuuucagcagaaccgcauuuauaugcauccggccgugcucacagcuggacgaaucagcgaaaugggcgucugcuucggcacuauccccguggccaauccugacgaugcagcccaggggucgggacacaccaaaucuauucugaacuuaagaacauccaccgagacgaauaacccaugugcuaagacuauaguuaaacuguuugaaauccaaaagacagguuucaauauucaggacauggauaucguggccucagagcaucuccuucaccagagucuggucggcaagcaaagccccuuucagaacgcauacaaugugaaagggaacgcgaccuccgcuaauauaauuuga

SEQ ID NO: 5969 - RNA, 1449 nt, Artificial Sequence
  derived and/or modified CDS sequence (opt3) from CCHFV(1231-CR/TI-2015)__KU161587.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaagcggccgcuccgggauugcuuugguggccaccggacucgcaaagcuggcugaaacagaggguaagggcguguuugacgaagccaaaaagaccgucgaggcgcugaauggguaucucgauaaacauagagacgaaguugacaaggccucagcagauaguaugaucacuaacuuacugaaacacauagcuaaggcccaagagcuuuacaagaauagcucugcuuugagggcccagggagcacagauugacacaccuuucuccucauuuuacuggcuguauaaagccggcgugaccccagagacguuccccacuaucagccaguuccuauuugaacucgguaagcaaccucgggggaccaaaaagaugaaaaaggcucugcuuaguacaccaaugaaguggggcaaaaagcuguacgaguuguucgcggaugacucuuuucagcagaaccgcauuuauaugcauccggcaguacucacugccggacgaaucuccgaaaugggcgugugcuucgggaccauccccgucgcuaauccugaugacgccgcacagggaagcggucacacaaaaucgauucugaacuuaagaaccucuacggagacuaauaacccaugugccaagacaauagugaaacuguuugaaauccaaaagaccggcuucaauauucaggauauggacaucguugcuuccgagcaucuccuucaccagucacugguggggaagcaaagucccuuucagaacgccuacaaugucaaaggaaacgcaacuagcgcgaauauaauuuga

SEQ ID NO: 5970 - RNA, 1449 nt, Artificial Sequence
  derived and/or modified CDS sequence (opt3) from CCHFV(AP92)__U04958.1__N
auggagaacaagaucgaagugaauagcaaagacgaucugaacaagugguucgaggaauuuaaaaagggcaaugggcucgucgacaccuucacaaacuccuacucuuuuugcgagaauguucccaaccuugauagauucguguaucagauggccucagcuacugacgaugcacaaaaagacaguauuuacgccagcgcgcugguagaagcuacgaaguauugugccccuauauacgagugcgcauggguguccucuaccggaaucgucaagaaagguuuggagugguuugaaaagaauacaucgacuauuaaaucaugggaugagagcuauaccgaauuaaagguggacaucccaaaaauugagcagcugaguuccuaccagcaggccgcucuaaaguggaggaaggauaucggcuuccggauaaacgcaaauacaaccgcccucucuaacaaaguucuggcugaguauaaggugccgggggaaauccuuguccccgugaaagagaugcugagcgacaugauucgccgacguaauaucauuuugaacagaggauccgaugaaaauccuaggggcccaguaucacacgagcauaucgaauggugucgggaguuuauaaaggguaaauacauuauggccuucaaucccccuuggggagacaucaacaagagugggcgcagcggcauugcgcucguugcaacuggccuggccaaacuggcugagacagaagggaagggaguguuugaggaagccaagaaaaccgucgaggcacucaaggauuacuuagacaaacacagagacgaaguggauaagacgucugcugacaacauggugacuucccugcuuaaacauaucgccaaggcgcaagaguuguauaagaacucaagcgcccugagggcacagggugcucagaucgauaccccauucaguucuuuuuacuggcuauauaaagccggcgucacacccgagacuuucccuaccguuucccaguuucucuucgaacuggggaagcaaccacggggaaccaaaaagaugaaaaaggcccuucugagcacaccgaugaaguggggcaaaaagcacuacgaguuguucgcugacgauucguuucagcagaaucgcauuuauaugcaucccgcagugcucacggccggucgaauaucugaaauggggguaugcuucggaacuaucccuguggcuaacccagacgaugcggcacagggcuccggccacacaaaaucaauucugaauuuaagaaccaacacugagaguaauaaccccugugccaggacaaucgucaagcuguuugaaauacagaaaaccggguucgacauuaaggauauggacaucguggcuagcgagcaccuccuucaucaaucccugguuggaaagcagucuccuuuucaaaaugccuacaacgugaaagguaaugcaacgagcgccaacaucauuuga

SEQ ID NO: 5971 - RNA, 1449 nt, Artificial Sequence
  derived and/or modified CDS sequence (opt3) from CCHFV(C68031)__M86625.1__N
auggagaacaagaucgaagugaauaacaaagacgagaugaauaagugguucgaagaguuuaaaaagggcaacgggcuggucgauaccuucacaaaucccuacagcuuuugcgaauccguuccuaaccucgagagauucguguuucagauggccucugcuacugacgaugcacaaaaagacucaauuuaugccagugcgcuuguagaggcuacgaaguucugugccccaauauacgaaugcgcaugggugagcuccaccggaaucgucaagaaaggucuggagugguuugaaaagaaugccggcacaauuaaaucuugggaugagucguauaucgaguugaagguggaaguuccgaaaauugagcaguuagcuaacuaccagcaggcagcccugaaguggaggaaggacaucggguuccgggugaaugcuaacacugccgcgcuaucacacaaaguccucgcagaauauaaggugcccggagagauaguaaugagcguuaaagaaaugcugagugauaugauccgccgacguaaucuuauucugaacagaggcggugacgagaauccuagggggccagugucccgggagcaugucgaauggugucgcgaguuugugaagggaaaauacaucauggccuucaaucccccuuggggcgauauuaacaagucuggcagaagcgggaucgcuuugguggccaccggacucgcaaaacuggcugaaacagaggguaagggcgucuuugacgaagccaagaaaaccguugaggcgcugaacggguaucucgauaagcacaaagacgagguggauaaggccuccgcagacaacaugauaacuaauuuacugaaacauauugcuaaggcccaagaacuuuacaagaacucaagugcuuugagggcccagggagcacagaucgacacagccuucagcucuuacuauuggcuguacaaagcuggcguaaccccagagacguuucccacugugucccaguuccuauucgaacucgguaagcaaccucgggggaccaaaaagaugaaaaaggcgcugcuuucaacaccaaugaaguggggcaaaaagcuguaugaguuguuugcagaugacagcuuccagcagaaucgcauuuacaugcacccggccguccucacugcuggacgaaucagugaaaugggcgugugcuuugggaccauccccguugccaacccugaugacgcagcccagggaucuggucauacaaaauccauucugaauuuaagaaccaacacggagacuaauaacccaugugcuaagacaauagugaaacuguucgagauccaaaagaccggcuuuaauauucaggauauggacaucgucgccagcgaacaccuccuucaccagucgcugguggggaagcaaucucccuuccagaacgcauauaauguaaaaggaaacgcgacuuccgcuaauauaauuuga

SEQ ID NO: 5972 - RNA, 1449 nt, Artificial Sequence
  derived and/or modified CDS sequence (opt3) from CCHFV(1-CR/HU-2015)__KU161586.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuaucagauggccucagcuacugaugacgcacaaaaggauaguauuuacgccagcgcgcuuguggaggcuacgaaguuuugugccccuauauaugagugcgcauggguauccucuaccggaaucgugaaaaagggucuggaaugguucgagaaaaauucgggcacaauuaagucaugggacgaaaacuacgccgaguugaaagucgaugugccaaagaucgagcaguuagcuaauuaucagcaggcagcccugaaguggagaaaagacauuggguuuaggguuaacgcuaauacugccgcgcuaagcaacaaggugcucgcagaauacaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguucgucaaaggaaaguauauuauggccuuuaacccacccuggggcgauaucaacaaaagcggccgcuccgggauugcuuugguggccaccggacucgcaaagcuggcugaaacagaggguaagggcguguucgacgaagccaaaaagaccgucgaggcgcugaauggguaccucgauaaacauagagacgaaguugacaaggccucagcagauaguaugacuacaaacuuacugaaacacaucgcuaaggcccaagagcuuuacaagaauagcucugcuuugagggcccagggagcacagauagacaccccuuuuuccucauucuauuggcuguacaaagccggcgugacgccagagacuuuucccaccauuagccaguuccuauucgaacucgguaagcaaccucgggggacuaaaaagaugaaaaaggcucugcuuaguacaccaaugaaguggggcaaaaagcuguaugaguuguuugcggaugacucuuuccagcagaaccgcaucuacaugcauccggcaguacucaccgccggacgaauuuccgaaaugggcgugugcuuugggacaauccccgucgcuaauccugaugacgccgcacagggaagcggucacaccaaaucgauccugaacuuaagaacgucuacugagacaaauaacccaugugccaagaccauugugaaacuguucgaaauacaaaagacuggcuuuaauauccaggauauggacauuguugcuuccgagcaucuccuucaccagucacugguggggaagcaaagucccuuccagaacgccuauaaugucaaaggaaacgcaacaagcgcgaauaucauauga

SEQ ID NO: 5973 - RNA, 1449 nt, Artificial Sequence
  derived and/or modified CDS sequence (opt3) from CCHFV(36-ST-2014)__KR814838.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauacaggcacuauuaagucgugggacgauaacuaugccgaauugaaagucgacgugccaaagaucgagcaguuagcuaauuaccagcaggcagcccugaaguggagaaaagauauuggguucaggguuaacgcuaauaccgccgcgcuaucaaacaaggugcucgcagaguauaaagucccgggagaaaucgugaugagcguaaaggagaugcugagugacaugauacggcgccgaaaucuuauccugaaccguggcggugaugggaaucccagaggaccuguuucccacgaacauguggagugguguagggaauuugucaaaggcaaguacauuauggccuucaacccacccuggggcgacaucaacaaaucugggcggagcggaauugcuuugguggccacaggucucgcaaagcuggcugagaccgagggcaaggggguguuugaugaagccaaacgcacugucgaggcgcugaauggauaucucgacaagcacagagacgaaguugauaaagccuccgcagacucaaugaucacaaacuuacugaagcauauagcuaaagcccaagagcuuuacaagaauaguagcgcuuugagggcccagggcgcacagauugauaccccuuucucuuccuuuuacuggcuguauaaggccggugugacgccagaaacuuuccccaccaucucacaguuccuauuugagcucgggaaacaaccucggggaacaaagaaaaugaagaaagcucugcuuagcacuccaaugaaguggggcaagaaacuguacgaguuguucgcggacgauaguuuucagcagaaccgcauuuauaugcacccggcaguacucaccgccggccgaaucucugaaaugggggugugcuucggaacaauccccgucgcuaauccugacgaugccgcacaggguuccggccauaccaagagcauucugaacuuaagaacgucgacugagacaaauaacccaugugccaaaaccauagugaagcuguuugaaauccagaaaacuggguucaauauucaagacauggauaucguugcuucugagcaccuccuucaccagucccuggugggaaagcaaucacccuuucagaacgccuacaaugucaagggcaacgcaacaagugcgaauauaauuuga

SEQ ID NO: 5974 - RNA, 1449 nt, Artificial Sequence
  derived and/or modified CDS sequence (opt3) from CCHFV(37-ST-2009)__KR814835.1__N
auggagaacaagaucguggucaauagcaaagacgaaaugaacaagugguucgaggaauuuaaaaagguuaauggccugguggauaccuucacaaacuccuacucuuuuugcgagaauguacccaaccucgacaaauucguguuucagauggccucagcuacugaugacgcacaaaaggauaguauuuaugccagcgcgcuugucgaagcuacgaaguucugugccccuauauacgagugcgcauggguguccucuaccgggaucguuaaaaagggacuggagugguuugaaaagaaugccgguacaauuaagucgugggacgagucauauacugaauugaaaguggaugucccaaagaucgagcaguuagcuagcuaccagcaggcagcccugaaguggagaaaagacauuggcuucagggugaacgcuaauaccgccgcgcuaaguuccaagguacucucugaguauaaaguuccgggggaaguggucaugcccgugaaggagaugcugagcgauaugauccggcgccgaaaccuuauacugaaucguggauccgacgaaaacccuagaggcccagugucaagggagcacgucgaauggugucgggaguuuguuaaagguaaguacaucauggcauucaaucccccuuggggagauauuaacaaaagugggcgcagcggcaucgccuugguggcuacaggccucgccaagcuggcagagaccgaagggaagggaauuuuugaggaagcuagaaaaacuguagacgcccugaaggauuaucucgacaggcauaaagaggaaguggacaagacaaaugcggauaacauggucaccaacuuauucaaacacaucgccaaggcacaagagcuguacaaaaauucuuccgcccuucgggcucagggugcucagauagacacgccauuuagcucauucuacugguuguauaaagccggcgugacucccgagaccuucccuacaguuagucaguuucuguucgaacuagggaagcaaccacgcggaacucgaaaaaugaagaaagcacuccugucuaccccgaugaaguggggcaagaaacuuuacgagcuguuugccgaugacuccuuccagcagaacagaauuuauaugcaucccgcuguguugacagcggguagggucagcgaaaugggggugugcuuuggaaccaucccuguagauaauccagacgaugcagcccagggcucgggccacacgaagucuauucucaaccugcggacuuccgcugagacaaauaaccccugugcccguaccaucguuaaauuauucgaaauccaaaaggcaggguuuaauauucaggagauggacauaguggccucagagcaucugcuccaccagagucuugucggaaaacaaagcccuuuccagaacgcuuacaaugugaaggguaacgccacuuccgcaaauaucauuuga

SEQ ID NO: 5975 - RNA, 1449 nt, Artificial Sequence
  derived and/or modified CDS sequence (opt3) from CCHFV(59-TK-2012)__KR814833.1__N
auggagaacaagaucguggucaauagcaaagacgaaaugaacaagugguucgaggaauuuaaaaagguuaauggccugguggauaccuucacaaacuccuacucuuuuugcgagaauguacccaaccucgacaaauucguguuucagauggccucagcuacugaugacgcacaaaaggauaguauuuaugccagcgcgcuugucgaagcuacgaaguucugugccccuauauacgagugcgcauggguguccucuaccgggaucguuaaaaagggacuggagugguuugaaaagaauacagguacuauuaagucgugggacgagucauauaccgaauugaaaguggaugucccaaagaucgagcaguuagccagcuaccagcaggcugcacugaaguggagaaaagacauuggcuucagggugaacgccaauacagcugcccuaaguuccaagguacucucugaguauaaaguuccgggggaaaucgugaugcccgucaaggagaugcugagcgauaugauacggcgccgaaaccuuauccugaaucguggauccgacgaaaacccuagaggcccagugucaagggagcacguggaauggugucgggaguuugucaaagguaaguacauuauggcguucaaucccccuuggggagauaucaacaaaagugggcgcagcggcauugcauugguugccaccggccucgcuaagcuggccgagacugaagggaagggaaucuuugaggaagcaagaaaaacaguggacgcucugaaggauuaucucgacaggcauaaagaggaaguagacaagaccaaugccgauaacauggugacgaacuuauucaaacacauagcgaaggcccaagagcuguacaaaaauucuuccgcacuucgggcucagggugcccagauugacacuccauuuagcucauucuacugguuguauaaagcuggcgucacccccgagacauucccuacugugagucaguuucuguucgaacuagggaagcaaccacgcggaacccgaaaaaugaagaaagcccuccugucuacaccgaugaaguggggcaagaaacuuuacgagcuguuugcagaugacuccuuccagcagaacagaaucuauaugcaucccgccguuuugaccgcugguaggauuagcgaaaugggggugugcuuuggaacgaucccugucgauaauccagacgaugcggcacagggcucgggccacacuaagucuauccucaaccugcggacauccgccgagaccaauaaccccugugcuaaaacuauugugaaguuauucgaaauacaaaaagccggguuuaauauccaggagauggacauuguagcaucagagcaucugcuccaccagagucuuguuggaaagcaaagcccuuuccagaacgccuacaaugugaaggguaacgcuacauccgccaauaucauauga

SEQ ID NO: 5976 - RNA, 1449 nt, Artificial Sequence
  derived and/or modified CDS sequence (opt3) from CCHFV(73-ST-2013)__KR814836.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaaagggucuggaaugguuugagaaaaaugccggcacaauuaagucgugggacgaaucauauacugaguugaaaguggauguuccaaagaucgagcaguuagcuaacuaccagcaggcagcccugaaguggagaaaagacauuggguucagggugaaugcuaacaccgccgcgcuaagcaauaagguccucgcagaauauaaagugccgggagagaucguaaugaguguuaaggaaaugcuguccgauaugauacggcgccgaaaccaaauccuuaaucguggcggugacgagaaccccagagggccugugucuagggaacacgucgauuggugucgggaguuugugaaaggaaaguacauuauggccuucaauccacccuggggcgacaucaacaaaagcggccgcuccgggauugcucugguggccacaggauuggcaaagcucgcugagaccgaagguaagggcgucuuugaugaggccaaaaagacuguugaagcgcugaacggguaucuggacaaacauaaggacgagguggauagagccucagcagacaguaugaucacaaaucucuuaaaacacauagcuaaggcccaggaacuguacaagaacagcucugcucuuagggcccagggagcacagauugauaccgccuucuccucauacuauugguuguacaaagcuggcguaacgccugagacuuuuccaaccgugagccaauuccuguucgagcuagguaagcagccccgggggacuaaaaagaugaaaaaggcgcuccugaguacaccuaugaaguggggaaagaaacuuuaugaacuguuugcagacgauucuuuccagcagaaucgcaucuacaugcauccagccgucuugaccgcuggccgaauuuccgagaugggcgugugcuuugggacaaucccgguugccaaccccgacgaugcagcccaaggaagcggucacaccaaaucgauccucaaucugagaacgaacacugaaacaaauaacccuugugcuaggaccauugugaaguuauucgagauacagaaaacuggcuuuaauauccaggacauggauauugucgccucugaacaucugcuccaccaaucccuuguggggaagcagucaccauuccagaacgcauauaauguaaagggaaacgcgacaagugcuaauaucauauga

SEQ ID NO: 5977 - RNA, 1449 nt, Artificial Sequence
  derived and/or modified CDS sequence (opt3) from CCHFV(75-ST-2010)__KR814845.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcucugacgagaaucccagagguccuguuagcagggaacacguggaguggugucgggaguuugucaaagggaaguacauuauggccuucaacccacccuggggagauaucaacaaauccggccgcucaggcauugcuuugguggccaccgggcucgcaaagcuggcugaaacagagggaaaggguguguuugacgaagccaaaaagaccgucgaggcgcugaauggcuaucucgauaaacauagagacgaaguugacaaggccagugcagauagcaugaucacuaacuuacugaaacacauagcuaaggcccaagagcuuuacaagaauagcuccgcuuugagggcccagggggcacagauugacacaccuuucucaucuuuuuacuggcuguauaaagccggagugaccccagagacguuccccacuaucagucaguuccuauuugaacucggcaagcaaccucgggguaccaaaaagaugaaaaaggcucugcuuucuacaccaaugaagugggggaaaaagcuguacgaguuguucgcggaugacuccuuucagcagaaccgcauuuauaugcauccggcaguacucacugccggacgaaucagcgaaaugggcgugugcuucggcaccauccccgucgcuaauccugaugacgccgcacaggggucgggacacacaaaaucuauucugaacuuaagaaccuccacggagacuaauaacccaugugccaagacaauagugaaacuguuugaaauccaaaagaccgguuucaauauucaggauauggacaucguugcuucagagcaucuccuucaccagagucuggugggcaagcaaagccccuuucagaacgccuacaaugucaaagggaacgcaacuuccgcgaauauaauuuga

SEQ ID NO: 5978 - RNA, 1449 nt, Artificial Sequence
  derived and/or modified CDS sequence (opt3) from CCHFV(CHH)__KU707898.1__N
auggagaacaagaucgaagugaauagcaaagacgagaugaacaagugguucgaagaguuuaaaaagggcaaugggcuggucgauaccuucacaaacuccuacucuuuuugcgaaucaguucccaaucucgacagauucguguuucagauggccagugcuacugaugacgcacaaaaagauagcauuuaugccuccgcgcuuguagaggcuacgaaguucugugccccuauauacgagugcgcaugggccucuucgaccggaaucgugaagaaaggucuggaaugguuugagaagaacgcuggcacaauuaaaucaugggacgaaagcuauacugaguugaaggucgaggugccaaaaaucgaacaguuaaguaauuaccagcaggcagcccugaaguggaggaaggauauuggguuccggguuaacgcuaauaccgccgcgcuauccaacaaagugcucgcagaguauaaggucccgggagaaaucgugaugucuguaaaagagaugcugagcgacaugauacgccgacguaaucuuauccugaacagaggcggugaugaaaaucccagggggccuguuucccgggagcacguggaguggugucgcgaauuugucaagggaaaauacauuauggccuucaacccacccuggggcgacaucaauaagucaggcagaagugggauugcuuugguggccacaggacucgcaaaacuggcugagaccgaagguaagggcguguuugaugaggccaagaaaacugucgaagcgcugaacggguaucucgacaagcauaaagaugagguugacaaggccagcgcagacucuaugaucacaaacuuacugaaacacauagcuaaggcccaagagcuuuacaaaaauuccucagcuuugagggcccagggagcacagauugauaccguguucagcaguuacuauuggcuguacaaagccggcguaacgccugacacuuuuccaaccgugucucaguuccuauucgaacucgguaagcaaccccgggggacaaagaagaugaaaaaggcucugcuuuccacuccuaugaaguggggcaaaaagcuguaugaguuguuugcggaugacagcuuccagcagaaccgcaucuacaugcauccagcaguccucaccgccggacgaauuucggaaaugggcgugugcuuugggacaaucccgguugcuaaucccgaugacgccgcacugggaucuggucacaccaaauccaucuuaaaccugagaacgaauacugagacaaacaauccuugugccaagaccauugugaaacucuucgaaauacagaagacuggcuuuaacauccaagauauggacauugucgcuucagagcaucuucugcaccagaguuugguggggaagcagagcccauuccaaaaugccuauaacguaaaaggaaaugcaacauccgcgaacaucauauga

SEQ ID NO: 5979 - RNA, 1449 nt, Artificial Sequence
  derived and/or modified CDS sequence (opt3) from CCHFV(CJH)__KU707899.1__N
auggagaacaagaucgaagugaaaaauaagcacgagaaaaacaagugguucgaagaguuuaaaaagggcaaugggcuggucgacaccuucacaaacagcuacuccuuuugcgaaaauguucccaaccucgauagauucguguuucagauggccggagcuacugacgaugcacaaaaggacucuauuuaugccucagcgcuuguagaggcuacgaaauucugugccccuauauacgagugcgcaugggccaguagcaccgguaucgugaagaaaggccuggaaugguuugagaagaaugcugggacaauuaaauccugggaugaaucuuauacugaguugaaggucgaggugccaaagaucgaacaguuaucgaacuaccagcaggcagcccugaaauggaggaaggacauuggauuccggggcaaugcuaacaccgccgcgcuaucaaauaaaguucucgcagaguauaaggugccgggugaaaucgucaugagcgugaaagagaugcugagugauaugauacgccgacguaaccuuauccugaauagagggggagacgaaaaccccaggggcccuguaucccgggagcauguugaguggugucgcgaauuugugaagggcaaauacauuauggccuucaauccacccuggggagauaucaacaagucugggagaagcgguauugcuuuggucgccacaggccucgcaaagcuggcugagaccgaagggaaaggaguguuugacgaggccaagaaaacuguggaagcgcugaacggcuaucucgauaagcacaaagacgaggucgauaaggccuccgcagacucaaugaucacaaauuuacugaagcauauagcuaaagcccaagagcuuuacaagaacaguagcgcuuugagggcccagggugcacagauugacaccguuuucucuuccuacuauuggcuguacaaagccggggugacgccugaaacuuuuccaaccguaucacaguuccuauucgagcucggaaagcaaccccggggcacaaagaagaugaagaaagcucugcuuagcacuccuaugaaguggggcaaaaagcuguaugaauuguuugcggaugacaguuuccagcagaaucgcaucuacaugcacccagcagugcucaccgccgggcgaauuucugagaugggagucugcuuugguacaaucccgguggcuaaccccgaugacgccgcacugggcuccgggcauaccaaaagcaucuuaaaucugagaacgaacacugaaacaaauaacccuugugccaagaccauuguuaaacucuucgagauacagaaaacuggauuuaauauccaagauauggacauuguggcuucggagcaccuucugcaccagucuuuggucggcaagcaguccccauuccaaaacgccuauaaugugaaagguaacgcaacaucagcgaauaucauauga

SEQ ID NO: 5980 - RNA, 1449 nt, Artificial Sequence
  derived and/or modified CDS sequence (opt3) from CCHFV(CLT/TI05146)__DQ227496.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcugauuaccagcaggcagcccugaaguggaggaaggacauuggguuccgggugaacgcuaauaccacagcccuaagccacaaaguccucgcggaguauaaggugccgggagaaaucguaaugaguguuaaagagaugcuguccgauaugauacgccgacguaaccuuauccugaauagaggcggugacgaaaaccccagggggccugugucucgggagcaugucgaguggugucgcgaauuugugaagggaaaauacauuauggcauucaauccacccuggggcgauaucaacaagagcggcagauccgggauugccuugguggcuaccggacucgccaaacuggcagagacugaagguaagggcgucuuugacgaggcuaagaaaacaguugaagcccugaauggguaucucaacaagcacaaagaugagguggacaaggcgucagccgacaguaugaucaccaacuuacugaaacauauagcaaaggcucaagagcuuuacaagaauagcucugccuugagggcucagggagcccagauugauacggcauucuccucauacuauuggcuguacaaagccggcguaacuccugaaaccuuuccaacagugagccaguuccuauucgagcucgguaagcaaccccgggggacuaaaaagaugaaaaaggcucugcuuaguaccccucugaaguggggcaaaaaguuguaugaacucuuugcggacgauucuuuccagcagaaccgcaucuacaugcacccagcaguccugacagccggacgaauuuccgagaugggcgugugcuuugggaccaucccgguugcuaaucccgacgaugccgcacagggaagcggucauacgaaaucgaucuuaaaccugagaacuaauacagaaaccaacaauccuugugccaagacuauugugaaacucuucgagauacaaaagacaggcuuuaacauccaggacauggauauugucgcuucugagcaccuucugcaccaguccuugguggggaagcaaucaccauuccagaaugccuauaacguaaaaggaaaugcaaccagugcgaacaucauauga

SEQ ID NO: 5981 - RNA, 1449 nt, Artificial Sequence
  derived and/or modified CDS sequence (opt3) from CCHFV(CYT/TI05099)__DQ227495.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcugauuaccagcaggcagcccugaaguggaggaaggacauuggguuccgggugaacgcuaauaccacagcccuaagccacaaaguccucgcggaguauaaggugccgggagaaaucguaaugaguguuaaagagaugcuguccgauaugauacgccgacguaaccuuauccugaauagaggcggugacgaaaaccccagggggccugugucucgggagcaugucgaguggugucgcgaauuugugaagggaaaauacauuauggcauucaauccacccuggggcgauaucaacaagagcggcagauccgggauugccuugguggcuaccggacucgccaaacuggcagagacugaagguaagggcgucuuugacgaggcuaagaaaacaguugaagcccugaauggguaucucaacaagcacaaagaugagguggacaaggcgucagccgacaguaugaucaccaacuuacugaaacauauagcaaaggcucaagagcuuuacaagaauagcucugccuugagggcucagggagcccagauugauacggcauucuccucauacuauuggcuguacaaagccggcguaacuccugaaaccuuuccaacagugagccaguuccuauucgagcucgguaagcaaccccgggggacuaaaaagaugaaaaaggcucugcuuaguaccccucugaaguggggcaaaaaguuguaugaacucuuugcggacgauucuuuccagcagaaccgcaucuacaugcacccagcaguccugacagccggacgaauuuccgagaugggcgugugcuuugggaccaucccgguugcuaaucccgacgaugccgcacagggaagcggucauacgaaaucgaucccuaacuuaagaacuaauacagaaaccaacaauccaugugccaagacuauugugaaacuguucgagauacaaaagacaggcuuuaacauccaggacauggauauugucgcuucugagcaccuccuucaccagucccugguggggaagcaaucacccuuccagaaugccuauaacguaaaaggaaaugcaaccagugcgaacaucauauga

SEQ ID NO: 5982 - RNA, 1449 nt, Artificial Sequence
  derived and/or modified CDS sequence (opt3) from CCHFV(Dubai 616)__JN108025.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacugaugacgcacaaaaagauucaauuuaugccagugcgcuuguagaggcuacgaaguucugugccccuauauacgagugcgcaugggugagcuccaccgguaucgucaagaaaggccuggaaugguuugagaagaaugccgggacaauuaaaucuugggacgaaucguauacugaguugaagguggagguuccaaaaaucgaacaguuagcuaacuaccagcaggcagcccugaaguggaggaaggauauuggauuccgggugaaugcuaacaccgccgcgcuaucacacaaaguccucgcagaguauaaggugccgggcgaaaucguaaugagcguuaaagagaugcugagugacaugauacgccgacguaaucuuauccugaacagagguggggaugaaaaucccaggggaccugugucccgggagcaugucgaguggugucgcgaauuugugaagggcaaauacauuauggccuucaacccacccuggggcgacaucaauaagucugggagaagcggaauugcuuugguggccacaggucucgcaaaacuggcugagaccgaaggcaagggggucuuugaugaggccaagaaaacuguugaagcgcugaacggauaucucgacaagcacaaagaugagguggacaaggccuccgcagacaacaugaucacaaauuuacugaaacauauagcuaaggcccaagagcuuuacaagaacucaagugcuuugagggcccagggcgcacagauugauaccgccuucagcucuuacuauuggcuguacaaagcugguguaacgccugaaacuuuuccaaccgugucccaguuccuauucgagcucgggaagcaaccccggggaacuaaaaagaugaaaaaggcgcugcuuucaacaccuaugaaguggggcaaaaagcuguaugaauuguuugcagacgauagcuuccagcagaaucgcaucuacaugcacccagccguccucaccgcuggccgaauuagugagaugggggugugcuuuggaacaaucccgguugccaaccccgacgaugcagcccaggguucuggccauaccaaauccauccugaauuuaagaacgaacacugaaacaaauaacccuugugcuaagaccauugugaaacuguucgagauacaaaagacuggguuuaauauccaggacauggauauugucgccagcgagcaccuccuucaccagucgcuggugggaaagcaaucuccauuccagaacgcauauaauguaaaaggcaacgcgacauccgcuaauaucauauga

SEQ ID NO: 5983 - RNA, 1449 nt, Artificial Sequence
  derived and/or modified CDS sequence (opt3) from CCHFV(GRH)__KU707900.1__N
auggagaacaagaucgaagugaauagcaaagacgagaugaacaagugguucgaagaguuuaaaaagggcaaugggcuggucgauaccuucacaaacuccuacucuuuuugcgaaucaguucccaaucucgacagauucguguuucagauggccagugcuacugaugacgcacaaaaagauagcauuuaugccuccgcgcuuguagaggcuacgaaguucugugccccuauauacgagugcgcaugggccucuucgaccggaaucgugaagaaaggucuggaaugguuugagaagaacgcuggcacaauuaaaucaugggacgaaagcuauacugaguugaaggucgaggugccaaaaaucgaacaguuaaguaauuaccagcaggcagcccugaaguggaggaaggauauuggguuccggguuaacgcuaauaccgccgcgcuauccaacaaagugcucgcagaguauaaggucccgggagaaaucgugaugucuguaaaagagaugcugagcgacaugauacgccgacguaaucuuauccugaacagaggcggugaugaaaaucccagggggccuguuucccgggagcacguggaguggugucgcgaauuugucaagggaauguacauuauggccuucaacccacccuggggcgacaucaauaaaucaggcagaagugggauugcuuugguggccacaggacucgcaaagcuggcugagaccgaagguaaaggcguguuugaugaggccaagaagacugucgaagcgcugaacggguaucucgacaaacauaaggaugagguugacaaagccagcgcagacucuaugaucacaaacuuacugaagcacauagcuaaagcccaagagcuuuacaaaaauuccucagcuuugagggcccagggagcacagauugauaccguguucagcaguuacuauuggcuguacaaggccggcguaacgccugacacuuuuccaaccgugucucaguuccuauucgaacucgguaagcaaccccgggggacaaagaaaaugaagaaagcucugcuuuccacuccuaugaaguggggaaagaaacuguaugaguuguuugcggaugacagcuuccagcagaaccgcaucuacaugcauccagcaguccucaccgccggccgaauuucggaaaugggcgugugcuuugggacaaucccgguugcuaaucccgaugacgccgcacugggaucuggucacaccaaguccaucuuaaaccugagaacgaauacugagacaaacaauccuugugccaaaaccauugugaaacucuucgaaauacagaagacuggcuuuaacauccaagauauggacauugucgcuucagagcaucuucugcaccagaguuugguggggaagcagagcccauuccaaaaugccuauaacguaaagggaaaugcaacauccgcgaacaucauauga

SEQ ID NO: 5984 - RNA, 1449 nt, Artificial Sequence
  derived and/or modified CDS sequence (opt3) from CCHFV(Iran-Gilan69)__KJ027521.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuagcuaccagcaggcagcccugaaguggagaaaagacauuggguucaggguuaaugcuaacacugccgcgcuaaguaauaaggugcucgcagaauauaaagucccgggagagaucgugauguccguaaaggaaaugcugucugauaugauacggcgccgaaaccuuauccugaaucguggcggugacgagaaccccagagggccuguuagcagggaacacguggaguggugucgggaguuugucaaaggaaaguacauuauggccuucaauccacccuggggcgauaucaacaaauccggccgcucagggauugcuuugguggccaccggacucgcaaagcuggcugaaacagaggguaagggcguguuugacgaagccaaaaagaccgucgaggcgcugaacggguaucucgauaaacauagagacgaaguugacaaggccagugcagauagcaugaucacuaauuuacugaaacacauagcuaaggcccaagagcuuuacaagaacucuuccgcuuugagggcccagggagcacagauugacacaccuuucagcucauuuuacuggcuguauaaagccggcgugaccccagagacguuccccacuaucagucaguuccuauuugaacucgguaagcaaccucgggggaccaaaaagaugaaaaaggcucugcuuucuacaccaaugaaguggggcaaaaagcuguacgaguuguucgcggaugacuccuuucagcagaaucgcauuuauaugcauccggcaguacucacugccggacgaaucagcgaaaugggcgugugcuucgggaccauccccgucgcuaacccugaugacgccgcacagggaucgggucacacaaaaucuauucugaauuuaagaaccuccacggagacuaacaauccaugugccaagacaauagugaaacuguuugaaauccaaaagaccggcuucaacauucaggauauggacaucguugcuucagagcaucuccuucaccagagucugguggggaagcaaagccccuuucagaaugccuacaacgucaaaggaaaugcaacuuccgcgaacauaauuuga

SEQ ID NO: 5985 - RNA, 1449 nt, Artificial Sequence
  derived and/or modified CDS sequence (opt3) from CCHFV(Iran-Isfahan78)__KJ027522.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaagcggccgcuccgggauugcuuugguggccaccggacucgcaaagcuggcugaaacagaggguaagggcguguuugacgaagccaaaaagaccgucgaggcgcugaauggguaucucgauaaacauagagacgaaguugacaaggccucagcagauaguaugaucacuaacuuacugaaacacauagcuaaggcccaagagcuuuacaagaauagcucugcuuugagggcccagggagcacagauugacacaccuuucuccucauuuuacuggcuguauaaagccggcgugaccccagagacguuccccacuguaagccaguuccuauuugaacucgguaagcaaccucgggggaccaaaaagaugaaaaaggcucugcuuaguacaccaaugaaguggggcaaaaagcuguacgaguuguucgcggaugacucuuuucagcagaaccgcaucuauaugcauccggcagugcucacugccggacgaauuuccgaaaugggcgucugcuucgggaccauccccguggcuaauccugaugacgccgcacagggaagcggucacacaaaaucgauccugaacuuaagaaccucuacggagacuaauaacccaugugccaagacaauuguuaaacuguuugaaauacaaaagaccggcuucaauauccaggauauggacauuguggcuuccgagcaucuccuucaccagucacuggucgggaagcaaagucccuuucagaacgccuacaaugugaaaggaaacgcaacuagcgcgaauaucauauga

SEQ ID NO: 5986 - RNA, 1449 nt, Artificial Sequence
  derived and/or modified CDS sequence (opt3) from CCHFV(Iran-KhRazavi72)__KJ485700.1__N
auggagaacaagaucgaagugaaaaauaagcacgagaaaaacaagugguucgaagaguuuaaaaagggcaaugggcuggucgacaccuuccccaacagcuacuccuuuugcgaaaauguuccuaaccucgauagauucguguuucagauggccggagcuacagacgaugcacaaaaggacucuauuuaugccucagcgcuuguagaggcuacuaaauucugugccccaauauacgagugcgcaugggccaguagcacggguaucgugaagaaaggccuggaaugguuugagaagaaugcugggaccauuaaauccugggaugaaucuuauacagaguugaaggucgaggugccgaagaucgaacaguuaucgaacuaccagcaggcagcccugaaauggaggaaggacauuggauuccggggcaaugcuaacacugccgcgcuaucaaauaaaguucucgcagaguauaaggugcccggugaaaucgucaugagcgugaaagagaugcugagugauaugauacgccgacguaaccuuauccugaauagagggggagacgaaaacccuaggggcccaguaucccgggagcauguugaguggugucgcgaauuuauuaagggcaaauacaucauggccuucaaucccccuuggggagauauuaacaagucugggagaagcgguaucgcuuugguggccaccggccucgcaaagcuggcugagacagaagggaaaggagucuuugacgaggccaagaaaaccguggaagcgcugaacggcuaucucgauaagcacaaagacgagguggauaaggccuccgcagacucaaugauaacuaauuuacugaagcauauugcuaaagcccaagagcuuuacaagaacaguagcgcuuugagggcccagggugcacagaucgacacagucuucucuuccuacuauuggcuguacaaagccgggguuaccccagaaacguuucccacugugucacaguuccuauucgagcucggaaagcaaccucggggcaccaaaaagaugaagaaagcucugcuuagcacaccaaugaaguggggcaaaaagcuguaugaauuguuugcggaugacaguuuccagcagaaucgcauuuacaugcacccggcaguacucacugccgggcgaaucucugagaugggagugugcuuugguaccauccccgucgcuaacccugaugacgccgcacugggcuccgggcauacaaaaagcauuuuaaaucugagaaccaacacggaaacuaauaacccaugugccaagacaauagugaaacucuucgagauccagaagaccggauuuaauauucaagauauggacaucguugcuucggagcaccuucugcaccagucuuuggugggcaagcagucccccuuccaaaacgccuauaaugucaaagguaacgcaacuucagcgaauauaauuuga

SEQ ID NO: 5987 - RNA, 1449 nt, Artificial Sequence
  derived and/or modified CDS sequence (opt3) from CCHFV(Iran-Zahedan19)__KJ676542.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacugaugacgcacaaaaagauucaauuuaugccagugcgcuuguagaggcuacgaaguucugugccccuauauacgagugcgcaugggugagcuccaccgguaucgucaagaaaggccuggaaugguuugagaagaaugccgggacaauuaaaucuugggacgaaucguauacugaguugaagguggagguuccaaaaaucgaacaguuagcuaacuaccagcaggcagcccugaaguggaggaaggauauuggauuccgggugaaugcuaacaccgccgcgcuaucacacaaaguccucgcagaguauaaggugccgggcgaaaucguaaugagcguuaaagagaugcugagugacaugauacgccgacguaaucuuauccugaacagagguggggaugaaaaucccaggggaccugugucccgggagcaugucgaguggugucgcgaauuugugaagggcaaauacauuauggccuucaacccacccuggggcgacaucaauaagucugggagaagcggaauugcuuugaucgccacaggucucgcaaaacuggcugagaccgaaggcaaggggguguuugaugaggccaagaaaacugucgaagcgcugaacggauaucucgacaagcacaaagaugagguugacaaggccuccgcagacaacaugauaacaaauuuacugaaacauauugcuaaggcccaagagcuuuacaagaacucaagugcuuugagggcccagggcgcacagaucgauaccgccuucagcucuuacuauuggcuguacaaagcuggugugacgccugaaacuuuuccaaccguaucccaguuccuauucgagcucgggaagcaaccccggggaacuaaaaagaugaaaaaggcgcugcuuucaacaccuaugcgcuggggcaagaaacuguaugaauuguuugcagacgauagcuuccagcagaaucgaauuuacaugcacccagccgugcucaccgcuggcagaaucagugagaugggggucugcuuuggaacaaucccgguggccaaccccgacgaugcagcccaggguucuggccauaccaaguccauucugaauuuaaggacgaacacugaaacaaauaacccuugugcuaaaaccauaguuaagcuguucgagauccagaaaacuggguuuaauauucaagacauggauaucguggccagcgagcaccuccuucaccagucgcuggucggaaagcaaucuccauuccagaacgcauauaaugugaagggcaacgcgacauccgcuaauauaauuuga

SEQ ID NO: 5988 - RNA, 1449 nt, Artificial Sequence
  derived and/or modified CDS sequence (opt3) from CCHFV(NIV 112143)__JN572089.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagaaaucguaaugaguguuaaagagaugcuguccgacaugauacgccgacguaaucuuauccugaacagaggcggugaugaaaaucccagggggccugugucucgggagcaugucgaguggugucgcgaauuugugaagggaaaauacauuauggccuucaacccacccuggggcgacaucaauaagagcggcagauccgggauugcuuugaucgccacaggacucgcaaaacuggcugagaccgaagguaagggcguguuugaugaggccaagaaaacugucgaagcgcugaacggguaucucgacaagcacaaagaugagguugacaaggccucagcagacaacaugauaacaaauuuacugaaacauauugcuaaggcccaagagcuuuacaagaacaguagcgcuuugagggcccagggagcacagaucgauaccgccuucucuuccuacuauuggcuguacaaagcuggcgugacgccugaaacuuuuccaaccguaucacaguuccuauucgagcucgguaagcaaccccgggggacuaaaaagaugaaaaaggcgcugcuuagcacaccuaugcgcuggggaaagaaacuguaugaauuguuugcagacgauaguuuccagcagaaucgaauuuacaugcacccagccgugcucaccgcuggcagaaucucugagaugggcgucugcuuugggacaaucccgguggccaaccccgacgaugcagcccagggauccggucauaccaagagcauucugaauuuaaggacgaacacugaaacaaauaacccuugugcuaaaaccauaguuaagcuguucgagauccagaaaacuggcuuuaauauucaagacauggauaucguggccucggagcaccuccuucaccagucucuggucgggaagcaauccccauuccagaacgcauauaaugugaagggaaacgcgacaucagcuaauauaauuuga

SEQ ID NO: 5989 - RNA, 1449 nt, Artificial Sequence
  derived and/or modified CDS sequence (opt3) from CCHFV(NIVA 118595)__JN572088.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagaaaucguaaugaguguuaaagagaugcuguccgacaugauacgccgacguaaucuuauccugaacagaggcggugaugaaaaucccagggggccugugucucgggagcaugucgaguggugucgcgaauuugugaagggaaaauacauuauggccuucaacccacccuggggcgacaucaauaagagcggcagauccgggauugcuuugguggccacaggacucgcaaaacuggcugagaccgaagguaagggcgucuuugaugaggccaagaaaacuguugaagcgcugaacggguaucucgacaagcacaaagaugagguggacaaggccucagcagacaacaugaucacaaauuuacugaaacauauagcuaaggcccaagagcuuuacaagaacaguagcgcuuugagggcccagggagcacagauugauaccgccuucucuuccuacuauuggcuguacaaagcuggcguaacgccugaaacuuuuccaaccgugucacaguuccuauucgagcucgguaagcaaccccgggggacuaaaaagaugaaaaaggcgcugcuuagcacaccuaugcgcuggggaaagaaacuguaugaauuguuugcagacgauaguuuccagcagaaucgaaucuacaugcacccagccguccucaccgcuggcagaauuucugagaugggcgugugcuuugggacaaucccgguugccaaccccgacgaugcagcccagggauccggucauaccaagagcauccugaauuuaaggacgaacacugaaacaaauaacccuugugcuaaaaccauugugaagcuguucgagauacagaaaacuggcuuuaauauccaagacauggauauugucgccucggagcaccuccuucaccagucucugguggggaagcaauccccauuccagaacgcauauaauguaaagggaaacgcgacaucagcuaauaucauauga

SEQ ID NO: 5990 - RNA, 1449 nt, Artificial Sequence
  derived and/or modified CDS sequence (opt3) from CCHFV(SPU 130/89)__KJ682821.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuugggacaaucccgguugccaaccccgacgaugcagcccaaggaagcggucacaccaagucgauccucaaucugaggacgaacacugaaacaaauaacccuugugcucggaccauugugaaauuauucgagauacagaagacuggcuuuaauauccaggacauggauauugucgccucugaacaucugcuccaccaaucccuuguggggaaacagucaccauuccagaacgcauauaauguaaagggaaacgcgacaagugcuaauaucguuuga

SEQ ID NO: 5991 - RNA, 1449 nt, Artificial Sequence
  derived and/or modified CDS sequence (opt3) from CCHFV(SPU 18/88)__KJ682818.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugguaacaaaucucuuaaagcacaucgcuaaagcccaggaacuguacaagaacagcucugcccuucgggcucagggagcacagauagauaccgccuucuccucauacuauugguuguacaaggcuggcgugacgccugagacuuuuccaaccgucagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaauuuacaugcauccagccguguugaccgcuggcagaaucuccgagaugggcguuugcuuugggacaauuccgguggccaaccccgacgaugcagcccaaggaagcggucacaccaagucgauccucaaucugaggacgaacacugaaacaaauaacccuugugcucggaccaucgucaaauuauucgagauucagaagacuggcuuuaauauacaggacauggauaucguggccucugaacaucugcuccaccaaucccuuguagggaaacagucaccauuccagaacgcauauaauguuaagggaaacgcgacaagugcuaauauuaucuga

SEQ ID NO: 5992 - RNA, 1449 nt, Artificial Sequence
  derived and/or modified CDS sequence (opt3) from CCHFV(SPU 187/90)__KJ682823.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuugggacaaucccgguugccaaccccgacgaugcagcccaaggaagcggucacaccaagucgauccucaaucugcagacgaacacugaaacaaauaacccuugugcuaggaccauugugaaauuauucgagauacagaagacuggcuuuaauauccaagacauggauauugucgccucugaacaucugcuccaccagucccuuguggggaaacagucaccauuccagaacgcauauaauguaaagggaaacgcgacaagugcuaauaucauauga

SEQ ID NO: 5993 - RNA, 1449 nt, Artificial Sequence
  derived and/or modified CDS sequence (opt3) from CCHFV(SPU 383/87)__KJ682816.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccggagcuacugaugacgcacaaaaggauucaauuuaugccagugcgcuuguagaggcuacgaaguucugugccccuauauacgagugcgcaugggugagcuccaccgguaucgucaaaagaggccuggaaugguuugagaagaaugccgggacaauuaaaucuugggacgaaucguauacugaguugaagguggauguuccaaaaaucgagcaguuagcuaacuaccagcaggcagcccugaaguggaggaaggacauuggauuccgggugaaugcuaacaccgccgcgcuaucaaauaaaguccucgcagaauauaaggugccgggcgagaucguaaugagcguuaaagaaaugcugagugauaugauacgccgacguaaccaaauccuuaauagagguggggacgagaaccccaggggaccugugucccgggaacacgucgauuggugucgcgaguuugugaagggcaaauacauuauggccuucaauccacccuggggcgacaucaacaagucugggagaagcggaauugcucugguggccacagguuuggcaaaacucgcugagaccgaaggcaagggggucuuugaugaggccaagaaaacuguugaagcgcugaacggauaucuggacaagcauaaagacgagguggauagggccuccgcagacucaaugaucacaaaucucuuaaagcacauagcuaaagcccaggaacuguacaagaacaguagcgcccuucgggcucagggcgcacagauugauaccgccuucucuuccuacuauugguuguacaaggcugguguaacgccugagacuuuuccaaccgugucacaauuccuguucgagcuagggaaacagccccgcggaacaaagaaaaugaagaaagcgcuccugagcacuccuaugaaguggggcaagaaacuuuaugaacuguuugcagacgauaguuuccagcagaaucgaaucuacaugcauccagccgucuugaccgcuggcagaauuucugagaugggggugugcuuuggaacaaucccgguugccaaccccgacgaugcagcccaagguuccggccacaccaagagcauccucaaucugaggacgaacacugaaacaucgaauccuugugcucggaccauugugaaauuauucgagauacagaagacuggguuuaacauccaggacauggauauugucgccucugaacaucugcuccaccaaucccuugugggaaaacagucaccauuccagaaugcauauaacguaaagggcaaugcgacaagugcuaacaucguuuga

SEQ ID NO: 5994 - RNA, 1449 nt, Artificial Sequence
  derived and/or modified CDS sequence (opt3) from CCHFV(SPU 383/87)__KJ682816.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccggagcuacugaugacgcacaaaaggauucaauuuaugccagugcgcuuguagaggcuacgaaguucugugccccuauauacgagugcgcaugggugagcuccaccgguaucgucaaaagaggccuggaaugguuugagaagaaugccgggacaauuaaaucuugggacgaaucguauacugaguugaagguggauguuccaaaaaucgagcaguuagcuaacuaccagcaggcagcccugaaguggaggaaggacauuggauuccgggugaaugcuaacaccgccgcgcuaucaaauaaaguccucgcagaauauaaggugccgggcgagaucguaaugagcguuaaagaaaugcugagugauaugauacgccgacguaaccaaauccuuaauagagguggggacgagaaccccaggggaccugugucccgggaacacgucgauuggugucgcgaguuugugaagggcaaauacauuauggccuucaauccacccuggggcgacaucaacaagucugggagaagcggaauugcucugguggccacagguuuggcaaaacucgcugagaccgaaggcaagggggucuuugaugaggccaagaaaacuguugaagcgcugaacggauaucuggacaagcauaaagacgagguggauagggccuccgcagacucaaugaucacaaaucucuuaaagcacauagcuaaagcccaggaacuguacaagaacaguagcgcccuucgggcucagggcgcacagauugauaccgccuucucuuccuacuauugguuguacaaggcugguguaacgccugagacuuuuccaaccgugucacaauuccuguucgagcuagggaaacagccccgcggaacaaagaaaaugaagaaagcgcuccugagcacuccuaugaaguggggcaagaaacuuuaugaacuguuugcagacgauaguuuccagcagaaucgaaucuacaugcauccagccgucuugaccgcuggcagaauuucugagaugggggugugcuuuggaacaaucccgguugccaaccccgacgaugcagcccaagguuccggccacaccaagagcauccucaaucugaggacgaacacugaaacaucgaauccuugugcucggaccauugugaaauuauucgagauacagaagacuggguuuaacauccaggacauggauauugucgccucugaacaucugcuccaccaaucccuugugggaaaacagucaccauuccagaaugcauauaacguaaagggcaaugcgacaagugcuaacaucauauga

SEQ ID NO: 5995 - RNA, 1449 nt, Artificial Sequence
  derived and/or modified CDS sequence (opt3) from CCHFV(SPU 431/85)__KJ682815.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuguguacgagugcgcaugggucuccucuaccggaauagugaaaagaggucuggaaugguuugagaagaaugccggcacaaucaaaucgugggacgaaucauauacugaguugaagguugaugugccaaaaauugagcaguuagcuaacuaccagcaggcagcccugaaguggaggaaggacaucggguuccgggucaaugcuaacaccgccgcgcuaagcaauaaagugcucgcagaauauaagguaccgggagagauuguuaugagugugaaagaaaugcuguccgauaugauccgccgacguaaccaaauacuuaauagaggcggugacgagaaccccagggggccugucucucgggaacacguggauuggugucgcgaguuugugaagggaaaauacaucauggccuucaauccacccuggggcgacauuaacaagagcggcagauccgggaucgcucuggucgccacaggauuggcaaaacucgcugagaccgaagguaagggcguuuuugaugaggccaagaaaacuguggaagcgcugaacggguaucuggacaagcauaaagacgagguagauagggccucagcagacaguaugauuacaaaucucuuaaagcacaucgcuaaagcccaggaacuguacaagaacagcucugcccuucgggcucagggagcacagauagauaccgccuucuccucauacuauugguuguacaaggcuggcgugacgccugagacuuuuccaaccgucagccaauuccuguucgagcuagguaaacagccccgcgggacaaagaaaaugaagaaagcgcuccugaguacuccuaugaaguggggaaagaaacuuuaugaacuguuugcagacgauaccuuccagcagaaucgaauuuacaugcauccagccguguugacagcuggcagaaucucugagaugggcguuugcuuugggaccauuccgguggccaaccccgacgaugcagcccaaggauccggucacacuaagagcauccucaaucugaggacgaacacagaaaccaauaacccuugugcucggacuaucgucaaauuauucgagauucagaagacaggcuuuaauauacaggacauggauaucguggccucggaacaucugcuccaccaaucucuuguagggaaacaguccccauuccagaacgcauauaauguuaagggaaacgcgaccucagugaauauuaucuga

SEQ ID NO: 5996 - RNA, 1449 nt, Artificial Sequence
  derived and/or modified CDS sequence (opt3) from CCHFV(SPU 45/88)__KJ682819.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuugggacaaucccgguugccaaccccgacgaugcagcccaaggaagcggucacaccaagucgauccucaaucugaggacgaacacugaaacaaauaacccuugugcucggaccauugugaaauuauucgagauacagaagacuggcuuuaauauccaggacauggauauugucgccucugaacaucugcuccaccaaucccuuguggggaaacagucaccauuccagaacgcauauaauguaaagggaaacgcgacaagugcuaauaucauauga

SEQ ID NO: 5997 - RNA, 1449 nt, Artificial Sequence
  derived and/or modified CDS sequence (opt3) from CCHFV(SPU 48/90)__KJ682822.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuucaagcacauagcuaaagcccaggaauuauacaagaacagcucugcucugcgggcccagggagcacagauugauaccgccuuuuccucauacuauuggcuuuacaaggcuggcguaacgccugagacuuucccaaccgugagccaauucuuguuugagcuggguaaacagccccgcgggacaaagaaaaugaagaaagcgcuacucaguacuccuaugaaguggggaaagaaacuguaugaacuuuucgcagacgauucuuuucagcagaaucgaaucuacaugcauccagccguccugaccgcuggcagaauuuccgagaugggcgugugcuucgggacaaucccgguugccaaccccgacgaugcagcccaaggaagcggucacaccaagucgaucuugaaucucaggacgaacacugaaacaaauaacccuugugcucggaccauugugaaacuguuugagauacagaagacuggcuucucuauccaggacauggauauugucgccuccgaacauuuacugcaccaaucacucguggggaaacagaguccauuucagaaugcauauaacguaaagggaaaugcgacaagcgcuaacaucauauga

SEQ ID NO: 5998 - RNA, 1449 nt, Artificial Sequence
  derived and/or modified CDS sequence (opt3) from CCHFV(SPU 497/88)__KJ682820.1__N
auggagaacaagaucgaagugaauaacaaagacgagaugaauaagugguucgaagaguuuaaaaagggcaacgggcuggucgauacuuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuuggggccaucccgguugcaaaccccgacgaugccgcucaaggaagcggucacacaaagucgauccucaaucugaggaccaacacggaaacuaauaacccuugugcccggacaauugugaaauuauucgagauacagaagaccggcuuuaauauccaggacauggauauugucgcaucugaacaucugcuccaccaaucccuuguggggaaacagucaccauuccagaacgcguauaauguaaagggaaacgcuaccagugccaauaucauauga

SEQ ID NO: 5999 - RNA, 1449 nt, Artificial Sequence
  derived and/or modified CDS sequence (opt3) from CCHFV(SPU 556/87)__KJ682817.1__N
auggagaacaagaucgaagugaauaacaaagacgagaugaauagaugguucgaagaguuuaagaaaggcaacgggcuggucgauaccuucacaaauagcuacuccuuuugcgaaucuguucccaaccucgacagguucguguuucagauggccggagcuacugaugacgcacaaaaggauucaauuuaugccagugcgcuuguagaggcuacgaaauucugugccccuauauacgagugcgcaugggugagcuccaccgguaucgucaagaagggccuggaaugguuugagaaaaaugccgggacaauuaagucuugggacgaaucguauacugaguugaaaguggauguuccaaagaucgagcaguuagcuaacuaccagcaggcagcccugaaauggcggaaggacauuggauuccgcgugaaugcuaacaccgccgcgcuaucaaauaagguccucgcagaauauaaagugccgggcgagaucguaaugagcguuaaggaaaugcugagugauaugauacgacguagaaaccaaauccuuaauagggguggggacgagaacccccggggaccugugucccgcgaacacgucgauugguguagagaguuugugaaaggcaaguacauuauggccuucaauccacccuggggcgacaucaacaaaucugggaggagcggaauugcucugguggccacagguuuggcaaagcucgcugagaccgaaggcaaaggggucuuugaugaggccaagaagacuguugaagcgcugaacggauaucuggacaaacauaaggacgagguggaucgggccuccgcagacucaaugaucacaaaucucuuaaaacacauagcuaaggcccaggaacuguacaaaaacaguagcgcccuucgcgcucagggcgcacagauugauaccgccuucucuuccuacuauugguuguacaaggcugguguaacgccugagacuuuuccaaccgugucacaauuccuguucgagcuagggaagcagccccgaggaacaaagaagaugaaaaaggcgcuccugagcacuccuaugaaauggggcaagaaacuuuaugaacuguuugcagacgauaguuuccagcagaauagaaucuacaugcauccagccgucuugaccgcuggcaggauuucugagaugggggugugcuuuggaacaaucccgguugccaaccccgacgaugcagcccaagguuccggccacaccaaaagcauccucaaucugcggacgaacacugaaacaaauaacccuugugcuaagaccauugugaaauuauucgagauacagaagacuggguuuaauauccaggacauggauauugucgccucggaacaucugcuccaccaaucucuugugggaaaacaguccccauuccagaacgcauauaauguaaagggcaacgcgacaucagcuaauaucauauga

SEQ ID NO: 6000 - RNA, 1449 nt, Artificial Sequence
  derived and/or modified CDS sequence (opt3) from CCHFV(SPU 92/01)__KC880335.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuugggacaaucccgguugccaaccccgacgaugcagcccaaggaagcggucacaccaagucgauccucaaucugcagacgaacacugaaacaaauaacccuugugcuaggaccauugugaaauuauucgagauacagaagacuggcuuuaauauccaagacauggauauugucgccucugaacaucugcuccaccagucccuuguggggaaacagucaccauuccagaacgcauauaauguaaagggaaacgcgacaaguguuaauaucauauga

SEQ ID NO: 6001 - RNA, 1449 nt, Artificial Sequence
  derived and/or modified CDS sequence (opt3) from CCHFV(SRR)__KU707901.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacugaugacgcacaaaaagauucaauuuaugccagugcgcuuguagaggcuacgaaguucugugccccuauauacgagugcgcaugggugagcuccaccgguaucgucaagaaaggccuggaaugguuugagaagaaugccgggacaauuaaaucuugggacgaaucguauacugaguugaagguggagguuccaaaaaucgaacaguuagcuaacuaccagcaggcagcccugaaguggaggaaggauauuggauuccgggugaaugcuaacaccgccgcgcuaucacacaaaguccucgcagaguauaaggugccgggcgaaaucguaaugagcguuaaagagaugcugagugacaugauacgccgacguaaucuuauccugaacagagguggggaugaaaaucccaggggaccugugucccgggagcaugucgaguggugucgcgaauuugugaagggcaaauacauuauggccuucaacccacccuggggcgacaucaauaagucugggagaagcggaauugcuuugguggccacaggucucgcaaaacuggcugagaccgaaggcaagggggucuuugaugaggccaagaaaacuguugaagcgcugaacggauaucucgacaagcacaaagaugagguggacaaggccuccgcagacaacaugaucacaaauuuacugaaacauauagcuaaggcccaagagcuuuacaagaacucaagugcuuugagggcccagggcgcacagauugauaccgccuucagcucuuacuauuggcuguacaaagcugguguaacgccugaaacuuuuccaaccgugucccaguuccuauucgagcucgggaagcaaccccggggaacuaaaaagaugaaaaaggcgcugcuuucaacaccuaugcgcuggggcaagaaacuguaugaauuguuugcagacgauagcuuccagcagaaucgaaucuacaugcacccagccguccucaccgcuggcagaauuagugagaugggggugugcuuuggaacaaucccgguugccaaccccgacgaugcagcccaggguucuggccauaccaaguccauccugaauuuaaggacgaacacugaaacaaauaacccuugugcuaaaaccauugugaagcuguucgagauacagaaaacuggguuuaauauccaagacauggauauugucgccagcgagcaccuccuucaccagucgcuggugggaaagcaaucuccauuccagaacgcauauaauguaaagggcaacgcgacauccgcuaauaucauauga

SEQ ID NO: 6002 - RNA, 1449 nt, Artificial Sequence
  derived and/or modified CDS sequence (opt3) from CCHFV(STV/HU29223)__AF481802.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaauuugagagggcccguuucuagggaacacguggaguggugucgggaguuugucaaaggaaaguacauuauggccuucaacccuccauggggcgauaucaacaaaagcggccgcuccgggauugcucucguggccaccggacuggcaaagcuggcugaaacagaggguaagggcguguuugacgaagccaaaaagaccgucgaggcgcucaauggguauuuagauaaacauagagacgaaguugacaaggccucagcagauaguaugaucacuaaccugcuuaaacacauagcuaaggcccaagaguuguacaagaauagcucugcucugagggcccagggagcacagauugacacacccuucuccucauuuuacuggcuauauaaagccggcgugaccccugagacguucccaacuaucagccaguuccucuuugaacuggguaagcaaccccgggggaccaaaaagaugaaaaaggcucuccugaguacaccuaugaaguggggcaaaaaguuguacgagcuuuucgcggaugacucuuuucagcagaaccgcauuuauaugcauccagcaguacugacugccggacgaaucuccgaaaugggcgugugcuucgggaccaucccggucgcuaaucccgaugacgccgcacagggaagcggucacacaaaaucgauuuuaaaccugagaaccucuacggagacuaauaacccuugugccaagacaauagugaaacucuuugaaauccaaaagaccggcuucaauauucaggauauggacaucguugcuuccgagcaucuucugcaccagucauugguggggaagcaaaguccauuucagaacgccuacaaugucaaaggaaacgcaacuagcgcgaauauaauuuga

SEQ ID NO: 6003 - RNA, 1449 nt, Artificial Sequence
  derived and/or modified CDS sequence (opt3) from CCHFV(TAJ/HU8966)__AY049083.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagaaaucguaaugaguguuaaagagaugcuguccgacaugauacgccgacguaaucuuauccugaacagaggcggugaugaaaaucccagggggccugugucucgggagcaugucgaguggugucgcgaauuugugaagggaaaauacauuauggccuucaacccacccuggggcgacaucaauaagagcggcagauccgggauugcuuugguggccacaggacucgcaaaacuggcugagaccgaagguaagggcgucuuugaugaggccaagaaaacuguugaagcgcugaacggguaucucgacaagcacaaagaugagguggacaaggccucagcagacaacaugaucacaaauuuacugaaacauauagcuaaggcccaagagcuuuacaagaacaguagcgcuuugagggcccagggagcacagauugauaccgccuucucuuccuacuauuggcuguacaaagcuggcguaacgccugaaacuuuuccaaccgugucacaguuccuauucgagcucgguaagcaaccccgggggacuaaaaagaugaaaaaggcgcugcuuagcacaccuaugaaguggggcaaaaagcuguaugaauuguuugcagacgauaguuuccagcagaaucgcaucuacaugcacccagccguccucaccgcuggacgaauuucugagaugggcgugugcuuugggacaaucccgguugccgaccccgaugacgcagcccagggauccggucauaccaaaagcauccugaacuuaagaacgaauacugaaacaaacaauccuugugcuaagaccauugugaaacuguucgagauacaaaagacuggcuuuaacauccaggauauggacauugucgccucggagcaccuccuucaccagucucugguggggaagcaauccccauuccagaaugcauauaacguaaaaggaaaugcgacaucagcuaacaucauauga

SEQ ID NO: 6004 - RNA, 1449 nt, Artificial Sequence
  derived and/or modified CDS sequence (opt3) from CCHFV(TAJ/HU8975)__AY297692.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauaucgaguugaagguggagguuccaaaaauugaacaguuagcuaacuaccagcaggcagcccugaaguggaggaaggauaucggguuccgggugaaugcuaacacugccgcgcuaagccacaaaguccucgcagaguauaaggugccgggagaaauaguaaugaguguuaaagagaugcuguccgacaugauccgccgacguaaucuuauucugaacagaggcggugaugaaaaucccagggggccugugucucgggagcaugucgaguggugucgcgaauuugugaagggaaaauacaucauggccuucaacccacccuggggcgacauuaauaagagcggcagauccgggaucgcuuugguggccaccggacucgcaaaacuggcugagacagaagguaagggcgucuuugaugaggccaagaaaaccguugaagcgcugaacggguaucucgacaagcacaaagaugagguggacaaggccucagcagacaacaugauaacuaauuuacugaaacauauugcuaaggcccaagagcuuuacaagaacaguagcgcuuugagggcccagggagcacagaucgauacagccuucucuuccuacuauuggcuguacaaagcuggcguaaccccugaaacguuuccaacugugucacaguuccuauucgagcucgguaagcaaccccgggggaccaaaaagaugaaaaaggcgcugcuuagcacaccuaugaaguggggcaaaaagcuguaugaauuguuugcagacgauaguuuccagcagaaucgcauuuacaugcacccagccguccucacugcuggacgaaucucugagaugggcgugugcuuugggaccaucccgguugccaaccccgacgaugcagcccagggauccggucauacaaaaagcauucugaauuuaagaaccaacacggaaacuaauaacccuugugcuaagacaauagugaaacuguucgagauccaaaagaccggcuuuaauauucaggacauggauaucgucgccucggagcaccuccuucaccagucucugguggggaagcaauccccauuccagaacgcauauaauguaaaaggaaacgcgacuucagcuaauauaauuuga

SEQ ID NO: 6005 - RNA, 1449 nt, Artificial Sequence
  derived and/or modified CDS sequence (opt3) from CCHFV(TAJ/HU8978)__AY297691.2__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccggagcuacugaugacgcacaaaaagauucaauuuaugccagugcgcuuguagaggcuacgaaguucugugccccuauauacgagugcgcaugggugagcuccaccgguaucgucaagaaaggccuggaaugguuugagaagaaugccgggacaauuaaaucuugggacgaaucguauacugaguugaagguggagguuccaaaaaucgaacaguuagcuaacuaccagcaggcagcccugaaguggaggaaggauauuggauuccgggugaaugcuaacaccgccgcgcuaucacacaaaguccucgcagaguauaaggugccgggcgaaaucguaaugagcguuaaagagaugcugagugacaugauacgccgacguaaucuuuuucugaacagagguggggaugaaaaucccaggggaccugugucccgggagcaugucgaguggugucgcgaguucgugaagggcaaauacaucauggccuuuaacccacccuggggcgacauuaauaagucugggagaagcggaaucgcuuugguggccacaggucucgcaaaacuggcugaaaccgaaggcaagggggucuucgaugaggccaagaggacuguugaagcgcugaacggauaucucgacaaacacaaggaugagguggacaaagccuccgcagacaacaugauuacaaauuuacugaagcauaucgcuaaagcccaagagcuuuacaagaacucaagugcuuugcgggcccagggcgcacagauagauaccagcuuuucuuccuacuauuggcuguacaaggccggucgcacgccugaaacuuucccaaccguaucacaguuccuauuugagcucgggaaacaaccccgaggaacaaagaaaaugaagaaagcucugcuuagcacuccuaugaaguggggcaagaaacuguaugaauuguucgcggacgauaguuuucagcagaauagaauuuacaugcacccagcagugcucaccgccggcaggaucucugagaugggggucugcuucggaacaauuccgguggcuaaccccgacgaugccgcacaggguuccggccauaccaagagcauccugaauuuacggacgaacacugaaacaaauaacccuugugccaaaaccaucguuaagcuguuugagauucagaaaacuggguucaauauacaagacauggauaucguggcuucggagcaccuccuucaccagucucuggucggaaagcaauccccauuucagaacgccuauaaugugaagggcaacgcaacaucagcgaauauuaucuga

SEQ ID NO: 6006 - RNA, 1449 nt, Artificial Sequence
  derived and/or modified CDS sequence (opt3) from CCHFV(Uzbek/TI10145)__AF481799.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcugauuaccagcaggcagcccugaaguggaggaaggacauuggguuccgggugaacgcuaauaccgccgcgcuaagccacaaaguccucgcagaguauaaggugccgggagaaaucguaaugaguguuaaagagaugcuguccgauaugauacgccgacguaaccuuauccugaauagaggcggugacgaaaaccccagggggccugugucucgggagcaugucgaguggugucgcgaauuugugaagggaaaauacauuauggccuucaauccacccuggggcgauaucaacaagagcggcagauccgggauugcuuugguggccacaggacucgcaaaacuggcugagaccgaagguaagggcgucuuugacgaggccaagaaaacuguugaagcgcugaauggguaucucgauaagcacaaagacgagguggacaaggccucagcagauaacaugaucacaaacuuacugaaacauauagcuaaggcccaagagcuuuacaagaauaguagcgcuuugagggcccagggagcacagauugacaccgccuucucuuccuacuauuggcuguacaaagcuggcguaacgccugaaacuuuuccaaccgugucacaguuccuauucgagcucgguaagcaaccccgggggacuaaaaagaugaaaaaggcgcugcuuagcacaccuaugaaguggggcaaaaagcuguaugaauuguuugcagaugacaguuuccagcagaaccgcaucuacaugcacccagccguccucaccgcuggacgaauuucugagaugggcgugugcuuugggacaaucccgguugccaaucccgaugacgcagcccagggauccggucauaccaaaagcauccugaacuuaagaacgaauacugaaacaaacaauccuugugcuaagaccauugugaaacuguucgagauacaaaagacuggcuuuaacauccaggauauggacauugucgccucggagcaccuccuucaccagucucugguggggaagcaauccccauuccagaaugcauauaacguaaaaggaaaugcgacaucagcuaacaucauauga

SEQ ID NO: 6007 - RNA, 1449 nt, Artificial Sequence
  derived and/or modified CDS sequence (opt3) from CCHFV(ROS/TI28044)__AY277672.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaccuggccgcagcgggauugcuuugguggccaccggacucgcaaagcuggcugaaacagaggguaagggcguguuugacgaagccaaaaagaccgucgaggcgcugaauggguaucucgauaaacauagagacgaaguugacaaggccuccgcagauucaaugaucgcuaacuuacugaaacacauagccaaggcucaagagcuuuacaagaauaguagcgccuugagggcacagggagcccagauugacacuccauucucuuccuuuuacuggcuguauaaagcuggcgugacacccgagaccuucccuacgaucucacaguuccuauuugaacucgguaagcaaccacgggggacuaaaaagaugaaaaaggcgcugcuuagcaccccgaugaaguggggcaaaaagcuguacgaguuguucgcagaugacaguuuucagcagaaccgcauuuauaugcaucccgccguacucacagcuggacgaaucucugaaaugggcgugugcuucgggacuaucccugucgccaauccagaugacgcagcccagggauccggucacaccaaaagcauucugaacuuaagaacaucgaccgagacgaauaaccccugugcuaagacuauagugaaacuguuugaaauccaaaagacaggcuucaauauucaggauauggacaucguugccucugagcaucuccuucaccagucccugguggggaagcaaucaccuuuucagaacgcauacaaugucaaaggaaacgcgaccagugcuaauauaauuuga

SEQ ID NO: 6008 - RNA, 1449 nt, Artificial Sequence
  derived and/or modified CDS sequence (opt3) from CCHFV(7001)__AF415236.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaggggucuggaaugguuugagaaaaaugccggcacaauuaagucgugggacgaaucauauacugaguugaaaguggagguuccaaagaucgaacaguuagcugauuaccagcaggcagcccugaaauggcggaaggacauuggguuccgcgugaacgcuaauaccacagcccuaagccacaagguccucgcggaguauaaagugccgggagaaaucguaaugaguguuaaggagaugcuguccgauaugauacgacguagaaaccuuauccugaauaggggcggugacgaaucuccccgggggccugugagccgcgagcaugucgagugguguagagaauuugugaaaggaaaguacauuauggcauucaacccacccuggggcgauaucaauaaauccggcaggucagggauugccuugguggcuaccggacucgccaagcuggcagagacugaagguaaaggcgucuuugacgaggcuaagaagacaguugaagcccugaacggguaucucaauaaacacaaggaugagguggacaaagcgagugccgacagcaugaucaccaacuuacugaagcauauagcaaaagcucaagagcuuuacaagaacucuuccgccuugcgggcucagggagcccagauugauacggcauucucaagcuacuauuggcuguacaaggccggcguaacuccugaaaccuuuccaacagugagucaguuccuauucgagcucgguaaacaaccccgcgggacuaagaaaaugaagaaagcucugcuuucuaccccucugaaguggggaaagaaauuguaugaacucuuugcggacgauuccuuccagcagaaucgaaucuacaugcacccagcaguccugacagccggcagaauuagcgagaugggcgugugcuuugggaccaucccgguugcuaaccccgacgaugccgcacagggaucgggucauacgaagucuaucuuaaaucugaggacuaacacagaaaccaauaacccuuguccaaaaacuauugugaaacucuucgagauacaaaagacaggcuuuaauauccaggacauggauauugucgccuccgagcaccuucugcaccagucauugguggggaagcaaagucccuuccagaacgcuuauaauguaaagggaaacgccaccagcgcaaauaucauauga

SEQ ID NO: 6009 - RNA, 1449 nt, Artificial Sequence
  derived and/or modified CDS sequence (opt3) from CCHFV(79121M18)__GU477494.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaggggucuggaaugguuugagaaaaaugccggcacaauuaagucgugggacgaaucauauacugaguugaaaguggagguuccaaagaucgaacaguuagcugauuaccagcaggcagcccugaaauggcggaaggacauuggguuccgcgugaacgcuaauaccacagcccuaagccacaagguccucgcggaguauaaagugccgggagaaaucguaaugaguguuaaggagaugcuguccgauaugauacgacguagaaaccuuauccugaauaggggcggugacgaaucuccccgggggccugugagccgcgagcaugucgagugguguagagaauuugugaaaggaaaguacauuauggcauucaacccacccuggggcgauaucaauaaauccggcaggucagggauugccuugguggcuaccggacucgccaagcuggcagagacugaagguaaaggcgucuuugacgaggcuaagaagacaguugaagcccugaacggguaucucaauaaacacaaggaugagguggacaaagcgagugccgacagcaugaucaccaacuuacugaagcauauagcaaaagcucaagagcuuuacaagaacucuuccgccuugcgggcucagggagcccagauugauacggcauucucaagcuacuauuggcuguacaaggccggcguaacuccugaaaccuuuccaacagugagucaguuccuauucgagcucgguaaacaaccccgcgggacuaagaaaaugaagaaagcucugcuuucuaccccucugaaguggggaaagaaauuguaugaacucuuugcggacgauuccuuccagcagaaucgaaucuacaugcacccagcaguccugacagccggcagaauuagcgagaugggcgugugcuuugggaccaucccgguugcuaaccccgacgaugccgcacagggaucgggucauacgaagucuaucuuaaaucugaggacuaacacagaaaccaauaacccuugugccaaaacuauugugaaacucuucgagauacaaaagacaggcuuuaauauccaggacauggauauugucgcuuccgagcaccuucugcaccagucauugguggggaagcaaaguccauuccagaacgccuauaauguaaagggaaacgcaaccagcgcgaauaucauauga

SEQ ID NO: 6010 - RNA, 1449 nt, Artificial Sequence
  derived and/or modified CDS sequence (opt3) from CCHFV(AP92)__DQ211638.1__N
auggagaacaagaucgaagugaauagcaaagacgaucugaacaagugguucgaggaauuuaaaaagggcaaugggcucgucgacaccuucacaaacuccuacucuuuuugcgagaauguucccaaccuugauagauucguguaucagauggccucagcuacugacgaugcacaaaaagacaguauuuacgccagcgcgcugguagaagcuacgaaguauugugccccuauauacgagugcgcauggguguccucuaccggaaucgucaagaaagguuuggagugguuugaaaagaauacaucgacuauuaaaucaugggaugagagcuauaccgaauuaaagguggacaucccaaaaauugagcagcugaguuccuaccagcaggccgcucuaaaguggaggaaggauaucggcuuccggauaaacgcaaauacaaccgcccucucuaacaaaguucuggcugaguauaaggugccgggggaaauccuuguccccgugaaagagaugcugagcgacaugauucgccgacguaauaucauuuugaacagaggauccgaugaaaauccuaggggcccaguaucacacgagcauaucgaauggugucgggaguuuauaaaggguaaauacauuauggccuucaaucccccuuggggagacaucaacaagagugggcgcagcggcauugcgcucguugcaacuggccuggccaaacuggcugagacagaagggaagggaguguuugaggaagccaagaaaaccgucgaggcacucaaggauuacuuagacaaacacagagacgaaguggauaagacgucugcugacaacauggugacuucccugcuuaaacauaucgccaaggcgcaagaguuguauaagaacucaagcgcccugagggcacagggugcucagaucgauaccccauucaguucuuuuuacuggcuauauaaagccggcgucacacccgagacuuucccuaccguuucccaguuucucuucgaacuggggaagcaaccacggggaaccaaaaagaugaaaaaggcucuccugagcacaccgaugaaguggggcaaaaaguuguacgagcuuuucgccgacgauucguuucagcagaaucgcauuuauaugcaccccgcagugcugacggccggucgaauaucugaaauggggguaugcuucggaacuaucccuguggcuaacccagacgaugcggcacagggcuccggccauacaaaaucaauuuuaaaucugagaaccaacacugagaguaauaaccccugugccaggacaaucgucaagcucuuugaaauacagaaaaccggguucgacauuaaggauauggacaucguggcuagcgagcaccuucugcaccaauccuugguuggaaagcagucuccuuuucaaaaugccuacaacgugaaagguaaugcaacgagcgccaacaucauuuga

SEQ ID NO: 6011 - RNA, 1449 nt, Artificial Sequence
  derived and/or modified CDS sequence (opt3) from CCHFV(ArD15786)__DQ211640.1__N
auggagaacaagaucgaagugaauaacaaagacgagcugaauaagugguucgaagaguuuaaaaagggcaacgggcucgucgauaccuucacaaauagcuacuccuuuugcgaaaacguucccaaucuugacagauucguguuucagauggccggagcuacugaugacgcacaaaaagauucuauuuaugccucagcgcugguagaggcuacgaaguacugugccccuauauaugagugcgcaugggugaguagcaccgguaucgucaagaggggcuuggaaugguucgagaaaaacacagggacuauuaaguccugggacgaaucuuacaccgaguuaaaaguggauguuccaaagaucgagcagcuggccaauuaucagcaggcugcacuaaaauggcggaaggacauuggauuucgcgugaacgccaauacagcugcccucucgaacaagguccugucagaauacaaagugccgggcgagaucguaaugagcguuaaggaaaugcuuagugauaugauacgacguagaaaucugaucuugaacagggguggggacgagaauccccggggaccuguguccaaagaacacauugaguggugucgcgaguucgucaagggcaaauauaucauggcguuuaacccacccuggggcgaugugaacaagucugggagaagcggaauugcacucguggccaccggucuggcuaaacuggccgaaacugagggcaagggggucuucgaagaggcaaagaaaacaguugaagcucucaaggaguacuuagacaaacauaaggaugagguggacaaagccuccgcggacucaaugguaaccaaucugcuuaagcacaucacgaaggcccaagaauuguacaaaaacaguagcgcacugagggcucagggagcccagauagauacuccuuuuucuuccuucuauuggcuauacaaggcuggcgugaccccagagacauuucccacugucucacaguuccucuucgaacuggguaaacaaccucgggggaccaagaaaaugaagaaggcccuucugagcacaccaaugaaauggggaaagaaauuguaugagcucuuugcagacgauaguuuccagcagaaucgcauuuacaugcauccggccgugcugaccgcuggccgaaucucugaaaugggcguuugcuuugggacgauucccguggcgaacccugacgaugcagcccagggauccggucacacuaagagcaucuuaaaucugagaacaaacucggagaccaauaacccaugugcuaaaacuaucgucaaacucuucgaggugcaaaagacaggcuuuaauauucaggacauggauauaguagccucugaacaucuucugcaccaguccuugguugggaagcaaucacccuuccagaacgcauauaaugugaagggaaacgccaccagugcuaauaucauuuga

SEQ ID NO: 6012 - RNA, 1449 nt, Artificial Sequence
  derived and/or modified CDS sequence (opt3) from CCHFV(ArD39554)__DQ211641.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauaaggccucagcagacaguaugaucacaaaucucuuaaaacacauagcuaaggcccaggaacuguacaagaacagcucugcucuuagggcccagggagcacagauugauaccgccuucuccucauacuauugguuguacaaagcuggcguaacgccugagacuuuuccaaccgugagccaauuccuguucgagcuagguaagcagccccgggggacuaaaaagaugaaaaaggcgcuccugacaaccccuaugaaguggggaaagaaacuuuaugaacuguuugcagacgauaguuuccagcagaaucgcaucuacaugcauccagccgucuugacagcuggccgaauuucugagaugggcgugugcuuugggaccaucccgguugccaaccccgacgaugcagcccaaggauccggucacacgaaaagcauccucaaucugagaacuaacacagaaaccaauaacccuugugcuaggacuauugugaaguuauucgagauacagaaaacaggcuuuaauauccaggacauggauauugucgccucggaacaucugcuccaccaaucucuuguggggaagcaguccccauuccagaacgcauauaauguaaagggaaacgcgaccucagcuaauaucauauga

SEQ ID NO: 6013 - RNA, 1449 nt, Artificial Sequence
  derived and/or modified CDS sequence (opt3) from CCHFV(BT958)__EF123122.1__N
auggagaacaagaucgaagugaauaacaaagacgagaugaauagaugguucgaagaguuuaagaaagaaaacggccuggucgauaccuucacaaauagccacuccuuuugcgagucuguucccaaccucgacaaguucguguuucagauggccucagcuacugaugacgcacaaaaagauaguauuuacgccgcggcucuuguagaggccacgaaguucugugcaccuauauaugaaugcgccugggugagcuccaccgggaucgucaagaaaggacuggagugguuugaaaagaaugcugguacaauuaaaucuugggacgagucguacacugaguugaagguggaaguuccaaaaaucgagcaguuaucaaacuaucagcaggcagcccugaaguggaggaaggauauuggcuuccgggugaaugcuaacaccgccacacuaagccauaaaguccucgcggaauacaaggugccgggggagaucguaaugaguguuaaagaaaugcuguccgacaugauacgccgacguaaucuuauccugaacagaggaggcgaugagaaucccagggguccugugucucgggagcacgucgaauggugucgcgaguuugugaaggggaaauauauuauggcauucaacccacccuggggagacaucaauaagagcggcagauccggcauugccuugguggcuaccgggcucgccaaacuggcagaagcugagggaaagggugucuuugaugaagccaagaaaacuguugaggcgcugaacggcuaccucgacaagcauaaagaugagguggacaagucaagugccgacagcaugaucacaaacuuacugaaacacauagcaaaggcucaagaacuuuauaggaacucuuccgccuugcgggcucagggggcccagauugauaccgcauucucaagcuacuacuggcuguauaaggccggaguaacgccugagacuuuuccaaccgugagucaguuccuauucgaacucggcaaacaaccccgcgguacaaagaaaaugaagaaagcucugcuuucuacuccuaugaagugggggaagaaacuguacgaguuguuugcggacgauuccuuccagcagaaucgaaucuauaugcauccagcaguccucaccgccggaagaauuagcgaaaugggcgugugcuuuggcacaaucccgguugcuaaucccgacgaugccgcacuggggucgggacacaccaagucuaucuuaaaccugaggacguccacugaggccaauaacccuugugcuaaaacaauugugaaacucuucgagauacagaagaaggguuuugucaucaaggacauggauauuguggccucagaacaccuucugcaucaaaguuugguaggcaaacagagcccauuccagaaugcauacaacguuaaggggaaugcgaccuccgcuaacaucauauga

SEQ ID NO: 6014 - RNA, 1449 nt, Artificial Sequence
  derived and/or modified CDS sequence (opt3) from CCHFV(C-68031)__DQ211642.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccucagcuacugacgaugcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauaucgaguugaagguggaaguuccaaaaauugagcaguuagcuaacuaccagcaggcagcccugaaguggaggaaggacaucggguuccgggugaaugcuaacacugccgcgcuaagccacaaaguccucgcagaauauaaggugccgggagagauaguaaugaguguuaaagaaaugcuguccgauaugauccgccgacguaaucuuauucugaacagaggcggugacgagaaucccagggggccugugucucgggagcaugucgaauggugucgcgaguuugugaagggaaaauacaucauggccuucaacccacccuggggcgauauuaauaagagcggcagauccgggaucgcuuugguggccaccggacucgcaaaacuggcugaaacagaggguaagggcgucuuugacgaagccaagaaaaccguugaggcgcugaacggguaucucgauaagcacaaagacgagguggauaaggccucagcagacaacaugauaacuaauuuacugaaacauauugcuaaggcccaagaacuuuacaagaacaguagcgcuuugagggcccagggagcacagaucgacacagccuucucuuccuacuauuggcuguacaaagcuggcguaaccccugagacguuuccaacugugucacaguuccuauucgaacucgguaagcaaccccgggggaccaaaaagaugaaaaaggcgcugcuuagcacaccuaugaaguggggcaaaaagcuguaugaguuguuugcagaugacaguuuccagcagaaucgcauuuacaugcacccagccguccucacugcuggacgaaucucugaaaugggcgugugcuuugggaccaucccgguugccaaccccgaugacgcagcccagggauccggucauacaaaaagcauucugaauuuaagaaccaacacggagacuaauaacccuugugcuaagacaauagugaaacuguucgagauccaaaagaccggcuuuaauauucaggauauggacaucgucgccucggaacaccuccuucaccagucucugguggggaagcaauccccauuccagaacgcauauaauguaaaaggaaacgcgacuucagcuaauauaauuuga

SEQ ID NO: 6015 - RNA, 1449 nt, Artificial Sequence
  derived and/or modified CDS sequence (opt3) from CCHFV(China)__AF354296.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccucagcuacugacgaugcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauacugaguugaagguggaaguuccaaaaaucgagcaguuagcuaacuaccagcaggcagcccugaaguggaggaaggacauuggguuccgggugaaugcuaacaccgccgcgcuaagccacaaaguccucgcagaauauaaggugccgggagagaucguaaugaguguuaaagaaaugcuguccgauaugauacgccgacguaaucuuauccugaacucuggcggugacgagaaucccagagggccugugagcagggagcaugucgaauggugucgggaguuugugaagggaaaauacauuauggccuucaacccacccuggggcgauaucaauaaguccggccgcucagggauugcuuugguggccacaggacucgcaaaacuggcugaaaccgguggcaagggggucuuugacgaggccaagaaaacuguugaagcgcugaacggauaucucgauaagcacaaagacgagguggauaaggccagugcagacaacaugaucacaaauuuacugaaacauauagcuaaggcccaagagcuuuacaagaacagcucugcuuugagagcccagggcgcacagauugacaccgccuucuccucauacuauuggcuguacaaagcuggugcgacgccugaaacuuuuccaaccguaagccaguuccuauucgagcucgggaagcaacccaggggaacuaaaaagaugaaaaaggcacugcuuaguacaccuaugaaguggggcaaaaagcuguaugaauuguuugccgaugacucuuuccagcagaaucggaucuacaugcacccagcugugcucaccgccggccgcauuuccgagaugggggucugcuuuggaacaaucccgguggcaaaccccgaugacgccgcucaggguagcggccauaccaaaucgauccugaauuuacgaacgaacacugaaacaaauaacccuugugccaagaccauuguuagacuguucgagauacagaaaacuggguuuaauauccaagauauggacauuguggcaucugagcaccuccuucaccagucccuggucggaaagcaaucaccauuccagaacgcguauaaugugaagggcaacgcuacaagugccaauaucauauga

SEQ ID NO: 6016 - RNA, 1449 nt, Artificial Sequence
  derived and/or modified CDS sequence (opt3) from CCHFV(China)__AF358784.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaggggucuggaaugguuugagaaaaaugccggcacaauuaagucgugggacgaaucauauacugaguugaaaguggagguuccaaagaucgaacaguucgcugauuaccagcaggcagccuuaaaauggcggaaggacauuggguuucgcgugaacgcuaauaccacagcccugagccacaagguccuagcggaguauaaagugccgggagaaaucguaaugaguguuaaggagaugcucuccgauaugauacgacguagaaaccugauccuuaauaggggcggugacgaaucuccccgggggccugugagccgcgagcaugucgagugguguagagaguucgugaaaggaaaguacauuauggcauuuaacccacccuggggcgauaucaauaaauccggcaggucagggauugcccugguggcuaccggauuggccaagcucgcagaaacugaagguaaaggcgucuucgacgaggcuaagaagacaguugaagcccugaacggguaucugaauaaacacaaggaugagguggacaaagcgagugccgacagcaugaucaccaaccucuuaaagcauauagcaaaagcucaagagcuguacaagaacucuuccgcccuucgggcucagggagcccagauugauacggcauuuucaagcuacuauugguuguacaaggccggcguaacuccugaaaccuucccaacagugagucaguuccuguuugagcuagguaaacaaccccgcgggacuaagaaaaugaagaaagcucuccugucuaccccucuuaaguggggaaagaaacuguaugaauuguucgcggacgauuccuuucagcagaaucgaaucuacaugcacccagcaguccucacagccggcagaauuagcgagaugggcgugugcuucgggaccaucccgguugcuaaccccgacgaugccgcacagggaucgggucauacgaagucuauccugaauuuaaggacuaacacagaaaccaauaacccuugugccaaaacuauugugaagcuguuugagauacagaaaacaggcuucaauauccaagacauggauauugucgcuuccgagcaccuccuucaccagucacugguggggaagcaaaguccauuucagaacgccuauaauguaaagggaaacgcaaccagcgcgaauaucauauga

SEQ ID NO: 6017 - RNA, 1449 nt, Artificial Sequence
  derived and/or modified CDS sequence (opt3) from CCHFV(China)__AF362080.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccucagcuacugacgaugcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauacugaguugaagguggaaguuccaaaaaucgagcaguuaaccaacuaccagcaggcugcacugaaguggaggaaggacauuggguuccgggugaaugccaacacagcugcccuaagccacaaaguccucgcggaauauaaggugccgggagagaucguaaugaguguuaaagaaaugcuguccgauaugauacgccgacguaaucuuauccugaacagaggcggugacgagaaucccagggggccugugucucgggagcaugucgaauggugucgcgaguuugugaagggaaccuacauuauggcauucaacccacccuggggcgauaucaauaaaagcggcagauccgggauugccuugguggcuacuggacucgccaagcuggcagaaacagaggguaaaggcgucuuugacgaagcuaagaagaccguugaggcccugaacggguaucucgauaaacacaaggacgagguggauaaagcgucagccgacaacaugaucacgaauuuacugaagcauauagcaaaagcucaagaacuuuacaagaacaguagcgccuugagggcucagggagcccagauugacacugcauucucuuccuacuauuggcuguacaaggccggcguaaccccugagacauuuccaacugugucacaguuccuauucgaacucgguaaacaaccccgggggaccaagaaaaugaagaaagcucugcuuagcacaccuaugaaguggggaaagaaacuguaugaguuguuugcggaugacaguuuccagcagaaucgcaucuacaugcacccagcaguccucaccgccggccgaauuucugaaaugggcgugugcuuugggacgaucccgguugcuaaccccgaugacgccgcacagggauccggucauacuaagagcauccugaauuuaagaacaaacaccgagacuaauaacccuugugccaaaacaauugugaagcuguucgagauacagaaaaccggcuuuaauauccaagauauggacauugucgcuucggaacaccuccuucaccagucucugguggggaagcaauccccauuccagaacgccuauaauguaaagggaaacgcaacgucagcgaauaucauauga

SEQ ID NO: 6018 - RNA, 1449 nt, Artificial Sequence
  derived and/or modified CDS sequence (opt3) from CCHFV(China)__AY029157.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgagagauucguguuucagauggccucagcuacugacgaugcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauacugaguugaagguggaaguuccaaaaaucgagcaguuagcuaacuaccagcaggcagcccugaaguggaggaaggacauuggguuccgggugaaugcuaacaccgccgcgcuaagccacaaaguccucgcagaauauaaggugccgggagagaucguaaugaguguuaaagaaaugcuguccgauaugauacgccgacguaaucuuauccugaacagaggcggugacgagaaucccagggggccugugucucgggagcaugucgaauggugucgcgaguuugugaagggaaaauacauuauggccuucaacccacccuggggcgauaucaauaagagcggcagauccgggauugcuuugguggccacaggacucgcaaaacuggcugaaaccgaggguaagggcgucuuugacgaagccaagaaaacuguugaggcgcugaacggguaucucgauaagcacaaagacgagguggauaaggccucagcagacaacaugaucacaaauuuacugaaacauauagcuaaggcccaagaacuuuacaagaacaguagcgcuuugagggcccagggagcacagauugacaccgccuucucuuccuacuauuggcuguacaaagcuggcguaacgccugagacuuuuccaaccgugucacaguuccuauucgaacucgguaagcaaccccgggggacuaaaaagaugaaaaaggcgcugcuuagcacaccuaugaaguggggcaaaaagcuguaugaguuguuugcagaugacaguuuccagcagaaucgcaucuacaugcacccagccguccucaccgcuggacgaauuucugaaaugggcgugugcuuugggacaaucccgguugccaaccccgaugacgcagcccagggauccggucauaccaaaagcauccugaauuuaagaacgaacacugagacaaauaacccuugugcuaagaccauugugaaacuguucgagauacaaaagacuggcuuuaauauccaggauauggacauugucgccucggaacaccuccuucaccagucucugguggggaagcaauccccauuccagaacgcauauaauguaaaaggaaacgcgacaucagcuaauaucauauga

SEQ ID NO: 6019 - RNA, 1449 nt, Artificial Sequence
  derived and/or modified CDS sequence (opt3) from CCHFV(DAK 8194)__U88411.1__N
auggagaacaagaucgaagugaauaacaaagacgagcugaauaagugguucgaagaguuuaaaaagggcaacgggcucgucgauaccuucacaaauagcuacuccuuuugcgaaaacaugcccaaucuugacagauucguuuuucagauggccggagcuacugaugacgcacaaaaagauucuauuuaugccucagcgcugguggaggcuacgaaguacugugccccuauauaugagugcgcauggguaaguagcaccgguaucgugaagaggggcuuggaaugguucgagaaaaacacagggacuauuaaguccugggacgaaucuuacaccgaguuaaaagucgaugugccaaagaucgagcagcuggccaauuaucagcaggcugcacuaaaauggcggaaggacauuggauuucgcguuaacgccaauacagcugcccucucgaacaaggugcugucagaauacaaagucccgggcgagaucgugaugagcguaaaggaaaugcuuagugauaugauacgacguagaaaucugaucuugaacagggguggggacgagaauccccggggaccuguuuccaaagaacacauugaguggugucgcgaguucgugaagggcaaauauaucauggcguuuaacccacccuggggcgaugucaacaagucugggagaagcggaauugcacucguggccaccggucuggcuaaacuggccgaaacugagggcaaggggguguucgaagaggcaaagaaaacagucgaagcucucaaggaguacuuagacaaacauaaggaugagguugacaaagccuccgcggacucaauggugaccaaucugcuuaagcacaucacgaaggcccaagaauuguacaaaaacaguagcgcacugagggcucagggagcccagauagauacuccuuuuucuuccuucuauuggcuauacaaggcuggcguaaccccagagacauuucccacugugucacaguuccucuucgaacuggguaaacaaccucgggggaccaagaaaaugaagaaggcccuucugagcacaccaaugaaauggggaaagaaauuguaugagcucuuugcagacgauaguuuccagcagaaucgcauuuacaugcauccggccguccugaccgcuggccgaaucucugaaaugggcgugugcuuugggacgauucccguugcggacccugaugacgcagcccagggauccggucacacuaagagcaucuuaaaccugagaacaucgucugagaccaauaacccaugugcuaaaacuaucgugaaacucuucgagguccaaaagacaggcuuuaauauucaggauauggacauaguggccuccgaacaucuucugcaccagucauugguagggaagcaaagucccuuccagaacgcauauaauguuaagggaaacgccaccagcgcuaauaucauuuga

SEQ ID NO: 6020 - RNA, 1449 nt, Artificial Sequence
  derived and/or modified CDS sequence (opt3) from CCHFV(Drosdov)__U88412.1__N
auggagaacaagaucgaagugaauagcaaagacgagaugaacaagugguucgaagaguuuaaaaaggaaaauggccugauggauaccuucacaaacuccuacucuuuuugcgagaauguccccaaccucgacaaauucguuuuucagauggccucagcuacugaugacgcacaaaaggauaguauuuaugccagcgcgcuuguggaggcuacgaaguucugugccccuauauacgaaugcgcauggguauccucuaccgggaucgugaaaaagggacuggagugguuugagaaaaauucggguacaauuaagucaugggacgaaaacuauacugaguugaaagucgaugugccaaagaucgaacaguuagccaauuaccagcaggcugcacugaaguggagaaaagacauuggcuucaggguuaacgccaauaccgcugcccuaagcaacaaggugcucgcggaguauaaagucccgggggaaaucgugaugaguguaaaggagaugcuguccgauaugauacggcgccgaaaucuuauccugaaccguggaggcgacgaaaaucccagagguccuguuucuagggagcacguggaguggugucgggaauuugucaaagggaaguacauuauggcauucaacccacccuggggagauaucaacaaaagcggccgcuccggcauugccuugguggcuacagggcucgccaagcuggcagagaccgaaggaaaggguguguuugacgaggcuaaaaagacugucgaagcccugaauggcuaucucgauaaacauagagacgagguugacaaggcgucagccgauaguaugaucacaaacuuacugaaacacauagcaaaggcucaagagcuuuacaagaauagcucugccuugagggcucagggggcccagauugacaccccuuucuccucauuuuacuggcuguauaaagcaggagugacgccagaaacuuuccccaccaucagccaguuccuauuugagcucggcaagcaaccucgggguacuaaaaagaugaaaaaggcccugcuuaguacaccaaugaagugggggaaaaagcuguacgaauuguucgcugaugacucuuuucagcagaaccgcauuuauaugcauccggcgguacucaccgcaggacgaaucuccgagaugggcgugugcuucggcacaauccccgucgccaauccugaugacgcugcccaggggagcggacacaccaaaucgauucugaacuuaagaacgucuacugaaacaaauaacccaugugcaaagaccauagugaaacuguuugagauccaaaagacugguuucaauauucaggauauggacaucguugccuccgagcaucuccuucaccagucacuggugggcaagcaaagucccuuucagaacgcuuacaaugucaaagggaacgccacaagcgcaaauauaauuuga

SEQ ID NO: 6021 - RNA, 1449 nt, Artificial Sequence
  derived and/or modified CDS sequence (opt3) from CCHFV(Eskisehir23-2012)__KR092376.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauacaggcacuauuaagucgugggacgaaaacuaugccgaguugaaagucgaugugccaaagaucgagcaguuagcuaauuaccagcaggcagcccugaaguggagaaaagacauuggguucaggguuaacgcuaauaccgccgcgcuaucaaacaaggugcucgcagaauauaaagucccgggagagaucgugaugagcguaaaggaaaugcugagugauaugauacggcgccgaaaucuuauccugaaccguggcgguggggagaaucccagaggaccuguuuccagggaacacguggaguggugucgggaguuugucaaaggcaaguacauuauggccuucaacccacccuggggcgacaucaacaaaucugggcgcagcggaauugcuuugguggccacaggucucgcaaagcuggcugaaaccgagggcaaggggguguuugaugaagccaaaagaacugucgaggcgcugaauggauaucucgacaagcauagggaugaaguugacaaagccuccgcagacucaaugaucacaaacuuacugaagcacauagcuaaagcccaagagcuuuacaagaauaguagcgcuuugcgggcccagggcgcacagauugauaccccuuucucuuccuuuuacuggcuguauaaggccggugugacgccagagacuuuccccaccaucucacaguuccuauuugaacucgggaaacaaccucgcggaacaaagaaaaugaagaaagcucugcuuagcacuccaaugaaguggggcaagaaacuguacgaguuguucgcggacgauaguuuucagcagaaccgaauuuauaugcauccggcaguacucaccgccggcagaaucucugaaaugggggugugcuucggaacaauccccgucgcuaauccugacgaugccgcacaggguuccggccacaccaagagcauucugaacuuaaggacgucgacugagacaaauaacccaugugccaaaaccauagugaagcuguuugaaauccagaaaacuggguucaauauucaagacauggauaucguugcuucugagcaucuccuucaccagucccuggugggaaagcaaucacccuuucagaacgccuacaaugucaagggcaacgcaacaagugcgaauauaauuuga

SEQ ID NO: 6022 - RNA, 1449 nt, Artificial Sequence
  derived and/or modified CDS sequence (opt3) from CCHFV(Hodzha)__AY223475.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucagugaguauaaggugccgggagaaaucguaauguccguuaaagagaugcugucugacaugauacgccgacguaaucuuauccugaacagaggcggugaugaaaaucccagggggccugugagccgggagcaugucgaguggugucgcgaauuugugaagggaaaauacauuauggcauucaacccacccuggggcgacaucaauaaguccggcagaucagggauugccuugguggcuacaggacucgccaaacuggcagagaccgaagguaagggcgucuuugaugaggcuaagaaaacuguugaagcccugaacggguaucucgacaagcacaaagaugagguggacaaggcgagugccgacaacaugacaaccaauuuacugaaacauaucgcaaaggcucaagagcuuuacaagaacagcucugccuugagggcucagggagcccagauagauacggcauucuccucauacuauuggcuguacaaagccggcguaacuccugaaaccuuuccaacagugagccaguuccuauucgagcucgguaagcaaccccgggggacuaaaaagaugaaaaaggcucugcuuaguaccccuaugaaguggggcaaaaagcuguaugaauuguuugcggacgauucuuuccagcagaaucgcauuuacaugcacccagcaguccucacagccggacgaaucuccgagaugggcgugugcuuugggaccguuccgguggcugaccccgaugacgccgcacagggaagcggucauacgaaaucgauucugaacuuaagaacuaauacagaaaccaacaauccuugugccaagacuaucgucaaacuguucgagauccaaaagacaggcuuuaacauucaggauauggacauaguggcuucugagcaccuccuucaccagucccugguagggaagcaaucaccauuccagaaugccuauaacguuaaaggaaaugcaaccagugcgaacaucauuuga

SEQ ID NO: 6023 - RNA, 1449 nt, Artificial Sequence
  derived and/or modified CDS sequence (opt3) from CCHFV(Iran-52)__DQ446212.1__N
auggagaacaagaucgaagugaauagcaaagacgagaugaacaagugguucgaagaguuuaaaaagggcaaugggcuggucgauaccuucacaaacuccuacucuuuuugcgaaucaguucccaaucucgacagauucguguuucagauggccagugcuacugaugacgcacaaaaagauagcauuuaugccuccgcgcuuguagaggcuacgaaguucugugccccuauauacgagugcgcaugggccucuucgaccggaaucgugaagaaaggucuggaaugguuugagaagaacgcuggcacaauuaaaucaugggacgaaagcuauacugaguugaaggucgaggugccaaaaaucgaacaguuaaguaauuaccagcaggcagcccugaaguggaggaaggauauuggguuccggguuaacgcuaauaccgccgcgcuauccaacaaagugcucgcagaguauaaggucccgggagaaaucgugaugucuguaaaagagaugcugagcgacaugauacgccgacguaaucuuauccugaacagaggcggugaugaaaaucccagggggccuguuucccgggagcacguggaguggugucgcgaauuugucaagggaaaauacauuauggccuucaacccacccuggggcgacaucaauaagucaggcagaagugggauugcuuugguggccacaggacucgcaaaacuggcugagaccgaagguaagggcguguuugaugaggccaagaaaacugucgaagcgcugaacggguaucucgacaagcauaaagaugagguugacaaggccagcgcagacucuaugaucacaaacuuacugaaacacauagcuaaggcccaagagcuuuacaaaaauuccucagcuuugagggcccagggagcacagauugauaccguguucagcaguuacuauuggcuguacaaagccggcguaacgccugacacuuuuccaaccgugucucaguuccuauucgaacucgguaagcaaccccgggggacaaagaagaugaaaaaggcucugcuuuccacuccuaugaaguggggaaagaagcuguaugaguuguuugcggaugacagcuuccagcagaaccgcaucuacaugcauccagcaguccucaccgccggccgaauuucggaaaugggcgugugcuuugggacaaucccgguugcuaaucccgaugacgccgcacugggaucuggucacaccaaauccaucuuaaaccugagaacgaauacugagacaaacaauccuugugccaggaccauugugaaacucuucgaaauacagaaaacuggcuuuaacauccaagauauggacauugucgcuucagagcaucuucugcaccagaguuugguggggaagcagagcccauuccaaaaugccuauaacguaaagggaaaugcaacauccgcgaacaucauauga

SEQ ID NO: 6024 - RNA, 1449 nt, Artificial Sequence
  derived and/or modified CDS sequence (opt3) from CCHFV(Iran-53)__DQ446213.1__N
auggagaacaagaucgaagugaauagcaaagacgagaugaacaagugguucgaagaguuuaaaaagggcaaugggcuggucgauaccuucacaaacuccuacucuuuuugcgaaucaguucccaaucucgacagauucguguuucagauggccagugcuacugaugacgcacaaaaagauagcauuuaugccuccgcgcuuguagaggcuacgaaguucugugccccuauauacgagugcgcaugggccucuucgaccggaaucgugaagaaaggucuggaaugguuugagaagaacgcuggcacaauuaaaucaugggacgaaagcuauacugaguugaaggucgaggugccaaaaaucgaacaguuaaguaauuaccagcaggcagcccugaaguggaggaaggauauuggguuccggguuaacgcuaauaccgccgcgcuauccaacaaagugcucgcagaguauaaggucccgggagaaaucgugaugucuguaaaagagaugcugagcgacaugauacgccgacguaaucuuauccugaacaagggcggugaugaaaaucccagagggccuguuuccagggagcacguggaguggugucgggaauuugucaaaggaaaguacauuauggccuucaacccacccuggggcgacaucaauaaaucaggccgcagugggauugcuuugguggccacaggacucgcaaagcuggcugagaccgaagguaagggcguguuugaugaggccaaaaagacugucgaagcgcugaacggguaucucgacaaacauaaggaugagguugacaaagccagcgcagacucuaugaucacaaacuuacugaagcacauagcuaaggcccaagagcuuuacaaaaauuccucagcuuugagagcccagggagcacagauugauaccguguucagcaguuacuauuggcuguacaaggccggcguaacgccugacacuuuuccaaccgugucucaguuccuauucgaacucgguaaacaacccagggggacaaagaaaaugaagaaggcucugcuuuccacuccuaugaaauggggaaagaaacuguaugaguuguuugcggaugacagcuuccagcagaaccggaucuacaugcauccagcaguccucaccgccggccgcauuucggaaaugggcgugugcuuugggacaaucccgguugcuaaucccgaugacgccgcacugggaucuggucacaccaaguccaucuuaaaccugcgaacgaauacugagacaaacaauccuugugccagaaccauugugaaacucuucgaaauacagaagacuggcuuuaacauccaagauauggacauugucgcuucagagcaucuucugcaccagaguuugguggggaagcagagcccauuccaaaaugccuauaacguaaaaggaaaugcaacauccgcgaacaucauauga

SEQ ID NO: 6025 - RNA, 1449 nt, Artificial Sequence
  derived and/or modified CDS sequence (opt3) from CCHFV(JD 206)__U88414.1__N
auggagaacaagaucgaagugaauagcaaagacgagaugaacaagugguucgaagaguuuaaaaagggcaaugggcuggucgauaccuucacaaacuccuacucuuuuugcgaaaauguucccaaccucgacagauucguguuucagauggccucagcuacugaugacgcacaaaaagauaguauuuaugccagcgcgcuuguagaggcuacgaaguucugugccccuauauacgagugcgcaugggccuccucuaccggaaucgugaagaaaggucuggaaugguuugagaagaaugcuggcacaauuaaaucgugggacgaaucauauacugaguugaaggucgaggugccaaaaaucgaacaguuaagcaacuaccagcaggcagcccugaaguggaggaaggauauuggguuccggguuaaugcuaacaccgccgcgcuaaguaauaaagugcucgcagaguauaaggucccgggagaaaucgugauguccguaaaagagaugcugucugacaugauacgccgacguaaccuuauccugaauagaggcggugaugaaaaccccagggggccuguuagccgggagcacguggaguggugucgcgaauuugucaagggaauguacauuauggccuucaauccacccuggggcgacaucaacaaauccggcagaucagggauugcuuugguggccacaggacucgcaaagcuggcugagaccgaagguaaaggcguguuugaugaggccaagaagacugucgaagcgcugaacggguaucucgacaaacauaaggaugagguugacaaagccagugcagacagcaugaucacaaauuuacugaagcacauagcuaaagcccaagagcuuuacaagaacucuuccgcuuugagggcccagggagcacagauugauaccguguucucaagcuacuauuggcuguacaaggccggcguaacgccugacacuuuuccaaccgugagucaguuccuauucgaacucgguaaacaaccccgggggacaaagaaaaugaagaaagcucugcuuucuacuccuaugaaguggggaaagaaacuguaugaguuguuugcggaugacuccuuccagcagaaucgcaucuacaugcauccagcaguccucaccgccggccgaauuagcgaaaugggcgugugcuuugggacaaucccgguugcuaaccccgaugacgccgcacugggaucgggucacaccaagucuaucuuaaaucugagaacgaacacugagacaaauaacccuugugccaaaaccauugugaaacucuucgaaauacagaagacuggcuuuaauauccaagauauggacauugucgcuuccgagcaucuucugcaccagucauugguggggaagcagaguccauuccaaaacgccuauaauguaaagggaaacgcaacaagcgcgaauaucauauga

SEQ ID NO: 6026 - RNA, 1449 nt, Artificial Sequence
  derived and/or modified CDS sequence (opt3) from CCHFV(Kashmanov)__DQ211644.1__N
auggagaacaagaucgaagugaauagcaaagacgagaugaacaagugguucgaagaguuuaaaaaggaaaauggccugauggauaccuucacaaacuccuacucuuuuugcgagaauguccccaaccucgacaaauucguuuuucagauggccucagcuacugaugacgcacaaaaggauaguauuuaugccagcgcgcuuguggaggcuacgaaguucugugccccuauauacgaaugcgcauggguauccucuaccgggaucgugaaaaagggacuggagugguuugagaaaaauucggguacaauuaagucaugggacgaaaacuaugccgaguugaaagucgaugugccaaagaucgaacaguuagcuaauuaccagcaggcagcccugaaguggagaaaagacauuggcuucaggguuaacgcuaauacugccgcgcuaagcaacaaggugcucgcagaguauaaagucccgggggaaaucgugaugaguguaaaggagaugcuguccgauaugauacggcgccgaaaucuuauccugaaccguggaggcgacgaaaaucccagagguccuguuucuagggagcacguggaguggugucgggaauuugucaaagggaaguacauuauggccuucaacccacccuggggagauaucaacaaaagcggccgcuccggcauugcuuugguggccaccgggcucgcaaagcuggcugagacagaaggaaaggguguguuugacgaggccaaaaagaccgucgaagcgcugaauggcuaucucgauaaacauagagacgagguugacaaggccucagcagauaguaugaucacuaacuuacugaaacacauagcuaaggcccaagagcuuuacaagaauagcucugcuuugagggcccagggggcacagauugacacaccuuucuccucauuuuacuggcuguauaaagccggagugaccccagaaacguuccccacuaucagccaguuccuauuugagcucggcaagcaaccucgggguaccaaaaagaugaaaaaggcucugcuuaguacaccaaugaagugggggaaaaagcuguacgaauuguucgcggaugacucuuuucagcagaaccgcauuuauaugcauccggcaguacucacugccggacgaaucuccgagaugggcgugugcuucggcaccauccccgucgcuaauccugaugacgccgcacaggggagcggacacacaaaaucgauucugaacuuaagaaccucuacggaaacuaauaacccaugugccaagacaauagugaaacuguuugagauccaaaagaccgguuucaauauucaggauauggacaucguugcuuccgagcaucuccuucaccagucacuggugggcaagcaaagucccuuucagaacgccuacaaugucaaagggaacgcaacuagcgcgaauauaauuuga

SEQ ID NO: 6027 - RNA, 1449 nt, Artificial Sequence
  derived and/or modified CDS sequence (opt3) from CCHFV(NIV 10405051)__JF922681.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcauggguguccucuaccggaaucgucaagaaaggucuggaaugguuugagaagaaugccggcacaauuaaaucgugggacgaaucauauacugaguugaagguggagguuccaaaaaucgaacaguuagcuaacuaccagcaggcagcccugaaguggaggaaggauauuggguuccgggugaaugcuaacaccgccgcgcuaagccacaaaguccucgcagaguauaaggugccgggagaaaucguaaugaguguuaaagagaugcuguccgacaugauacgccgacguaaucuuauccugaacagaggcggugaugaaaaucccagggggccugugucucgggagcaugucgaguggugucgcgaauuugugaagggaaaauacauuauggccuucaacccacccuggggcgacaucaauaagagcggcagauccgggauugcuuugguggccacaggacucgcaaaacuggcugagaccgaagguaagggcgucuuugaugaggccaagaaaacuguugaagcgcugaacggguaucucgacaagcacaaagaugagguggacaaggccucagcagacaacaugaucacaaauuuacugaaacauauagcuaaggcccaagagcuuuacaagaacaguagcgcuuugagggcccagggagcacagauugauaccgccuucucuuccuacuauuggcuguacaaagcuggcguaacgccugaaacuuuuccaaccgugucacaguuccuauucgagcucgguaagcaaccccgggggacuaaaaagaugaaaaaggcgcugcuuagcacaccuaugcgcuggggaaagaaacuguaugaauuguuugcagacgauaguuuccagcagaaucgaaucuacaugcacccagccguccucaccgcuggcagaauuucugagaugggcgugugcuuugggacaaucccgguugccaaccccgacgaugcagcccagggauccggucauaccaagagcauccugaauuuaaggacgaacacugaaacaaauaacccuugugcuaaaaccauugugaagcuguucgagauacagaaaacuggcuuuaauauccaagacauugauaucgucgccucggagcaccuccuucaccagucucugguggggaagcaauccccauuccagaacgcauauaauguaaagggaaacgcgacaucagcuaauauaauuuga

SEQ ID NO: 6028 - RNA, 1449 nt, Artificial Sequence
  derived and/or modified CDS sequence (opt3) from CCHFV(Oman)__DQ211645.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcaugggccuccucuaccggaaucgugaagaaaggucuggaaugguuugagaagaaugcuggcacaauuaaaucgugggacgaaucauauacugaguugaaggucgaggugccaaaaaucgaacaguuaagcaacuaccagcaggcagcccugaaguggaggaaggauauuggguuccggguuaaugcuaacaccgccgcgcuaaguaauaaagugcucgcagaguauaaggucccgggagaaaucgugauguccguaaaagagaugcugucugacaugauacgccgacguaaccuuauccugaauagaggcggugaugaaaaccccagggggccuguuagccgggagcacguggaguggugucgcgaauuuauuaagggaaaauacaucauggccuucaauccacccuggggcgacauuaacaaguccggcagaucagggaucgcuuuggucgccacaggacucgcaaaacuggcugagaccgaagguaagggcguguuugaugaggccaagaaaacuguggaagcgcugaacggguaucucgacaagcauaaagaugaggucgacaaggccagugcagacagcaugauaacaaauuuacugaaacacauugcuaaggcccaagagcuuuacaagaacucuuccgcuuugagggcccagggagcacagaucgauaccguuuucucaagcuacuauuggcuguacaaagccggcgugacgccugacacuuuuccaaccguaagucaguuccuauucgaacucgguaagcaaccccgggggacuaaaaagaugaaaaaggcucugcuuucuacaccuaugaaguggggcaaaaagcuguaugaguuguuugcggaugacuccuuccagcagaaucgcauuuacaugcauccagcagugcucaccgccggacgaaucagcgaaaugggcgucugcuuugggacaaucccgguggcuaaccccgaugacgccgcacugggaucgggucacaccaaaucuauuuuaaaucugagaacgaacacugagacaaauaacccuugugccaagaccauaguuaaacucuucgaaauccagaagacuggcuuuaauauucaagauauggacaucguggcuuccgagcaucuucugcaccagucauuggucgggaagcagaguccauuccaaaacgccuauaaugugaaaggaaacgcaacaagcgcgaauauaauuuga

SEQ ID NO: 6029 - RNA, 1449 nt, Artificial Sequence
  derived and/or modified CDS sequence (opt3) from CCHFV(SCT ex Afghanistan)__JX908640.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugacgcacaaaaagauaguauuuaugccagcgcgcuuguagaggcuacgaaguucugugccccuauauacgagugcgcaugggccuccucuaccggaaucgugaagaaaggucuggaaugguuugagaagaaugcuggcacaauuaaaucgugggacgaaucauauacugaguugaaggucgaggugccaaaaaucgaacaguuaagcaacuaccagcaggcagcccugaaguggaggaaggauauuggguuccggguuaaugcuaacaccgccgcgcuaaguaauaaagugcucgcagaguauaaggucccgggagaaaucgugauguccguaaaagagaugcugucugacaugauacgccgacguaaccuuauccugaauagaggcggugaugaaaaccccagggggccuguuagccgggagcacguggaguggugucgcgaauuuauuaagggaaaauacaucauggccuucaauccacccuggggcgacauuaacaaguccggcagaucagggaucgcuuuggucgccacaggacucgcaaaacuggcugagaccgaagguaagggcguguuugaugaggccaagaaaacuguggaagcgcugaacggguaucucgacaagcauaaagaugaggucgacaaggccagugcagacagcaugauaacaaauuuacugaaacacauugcuaaggcccaagagcuuuacaagaacucuuccgcuuugagggcccagggagcacagaucgauaccguuuucucaagcuacuauuggcuguacaaagccggcgugacgccugaaacuuuuccaaccguaagucaguuccuauucgagcucgguaagcaaccccgggggacuaaaaagaugaaaaaggcucugcuuucuacaccuaugaaguggggcaaaaagcuguaugaauuguuugcggacgauuccuuccagcagaaucgcauuuacaugcauccagcagugcucaccgccggacgaaucagcgagaugggcgucugcuuugggacaaucccgguggcuaaccccgacgaugccgcacugggaucgggucacaccaaaucuauuuuaaaucugagaacgaacacugaaacaaauaacccuugugccaagaccauaguuaaacucuucgagauccagaagacuggcuuuaauauucaagacauggauaucguggcuuccgagcaucuucugcaccagucauuggucgggaagcagaguccauuccaaaacgccuauaaugugaaaggaaacgcaacaagcgcgaauauaauuuga

SEQ ID NO: 6030 - RNA, 1449 nt, Artificial Sequence
  derived and/or modified CDS sequence (opt3) from CCHFV(Semunya)__DQ076413.1__N
auggagaacaagaucgaagugaccagcaaagacgagaugaauagaugguucgaagaguuuaagaaauccaacggccuggucgauacauucacuaauucuuacucauuuugcgaaaguguucccaaccucgacagguucguguuucagauggccagcgcuacggaugacgcacaaaaggauuccauuuaugccucugcgcuuguagaggcuaccaaauucugugccccuauauacgagugcgcaugggugucgucaacagggaucgucaagaagggacuggaaugguuugagaaaaaugccgguacuauuaagagcugggacgaaaguuauaccgaguugaaagugggcguuccaaagaucgagcaguuagcuaacuaccagcaggcagcccugaaauggcggaaggauauuggguuccgcgugaaugcuaacacagccgcgcuauccaauaagguccucgcagaauauaaagugccgggagagaucguaaugucuguuaaggaaaugcugagcgacaugauacgacguagaaaccuuauccugaauaggggcggugaugagaacccccgggggccugugucccgcgaacacgucgagugguguagagaguuugugaaaggaaaguacauuauggccuucaauccacccuggggcgacaucaacaaaucaggcaggagugggauugcuuugguggccaccggacucgcaaagcuggcugaaacugaggguaaaggcgucuuugaugaagccaagaagacaguugaggcgcugaauggguaucucgacaaacauaaggaugaaguggacaaagccagcgcagacggaaugguaaccaacuuacugaagcacaucgcuaaagcccaagagcuuuacaagaacucuuccgcuuugcgggcccagggcgcacagauagauacgccuuucagcucauuuuacuggcuguauaaggccggugugaguccagagacuuuccccaccgucucucaguuccuauuugaacucgggaaacaaccucgcggaacaaagaaaaugaagaaagcucugcuuuccacuccaaugaaguggggcaagaaacuguacgaguuguucgcggacgauagcuuucaggaaaaucgaauuuauaugcauccggcagugcucaccgccggcagaaucucggagauggggguuugcuucggaacaauucccguggcuaacccugacgaugccgcacaggguucuggccacaccaaguccauccugaauuuaaggacgaacacugaaacaaauaacccaugugccaaaaccaucgucaagcuguuugagauucagaaaacuggguucaauauacaagacauggauaucguggcuucagagcaucuccuucaccagagucugguaggaaagcagagccccuuucaaaacgccuacaauguuaagggcaacgcaacauccgcgaauauuaucuga

SEQ ID NO: 6031 - RNA, 1449 nt, Artificial Sequence
  derived and/or modified CDS sequence (opt3) from CCHFV(SK 2015/human)__KX129738.1__N
auggagaacaagaucgaagugaauaacaaagacgagaugaauaagugguucgaagaguuuaaaaagggcaacgggcuggucgauacuuacacaaauagcuauuccuucugcgaaucuguucccaaccucgacagauuuguguuccagauggccucagcuacugaugacgcacaaaaagauaguauuuacgccagcgcgcuuguagaggcuacgaaguuuugugccccuauauaugagugcgcaugggccuccucuaccggaaucgugaagaaaggucuggaaugguucgagaagaaugcuggcacaauuaaauugugggacgaaucguacgcagaguuaaaggucgaggugccaaaaaucgaacagcugucaaacuaucagcaggccgcucuaaaguggaggaaggauauuggguuucggguuaaugccaacacugcggcacucagcaauaaagugcuggccgaguacaaggucccgggagaaaucgugaugaguguaaaagagaugcuuuccgacaugauacgccgacguaaccugaucuugaauagaggcggugaugaaaaccccagggggccuguuucucgggagcacguggaguggugucgcgaguucgucaagggaaaauauauuauggcuuuuaauccacccuggggcgacaucaacaagagcggcagauccgggauugcccucguggcaaccggacuggcuaaacuggccgagacagaagguaagggcguguucgaugaggcgaagaaaaccgucgaagcccucaacggguacuuagacaagcauaaagaugagguugacaaggcaucagcugacaguaugaucacuaaucugcuuaaacacauagccaaggcucaagaguuguacaagaacagcucugcccugagggcacagggagcccagauugauacaguguuuuccucauauuacuggcuauauaaagcuggcguaaccccugacacguucccaacugugagccaguuucucuucgaacuggguaagcaaccccgggggaccaaaaagaugaaaaaggcgcuucugaguacaccuaugaaguggggcaaaaaguuguacgaacucuucgcagaugacucuuuucagcagaaucgcaucuauaugcauccagccguccugacugcuggacgaauuuccgaaaugggcgugugcuucgggaccguuccgguggccaaccccgaugacgcagccuuaggaagcggucacacaaaaucgauccugaaucucagaaccaacacggagacuaauaacccuugugcuaagacaaucgucaaacuuuuugaaauucagaagaccggcuucaauauacaagauauggacaucguggccucugagcaucuguugcaccagucccuaguagggaagcagucaccauuucaaaacgcauacaauguuaaaggaaacgcgaccagugcuaauauuaucuga

SEQ ID NO: 6032 - RNA, 1449 nt, Artificial Sequence
  derived and/or modified CDS sequence (opt3) from CCHFV(SPU128/81/7)__DQ076415.1__N
auggagaacaagaucgaagugaauaacaaacacgagaugaauaagugguucgaagaguuuaaaaagggcaacgggcuggucgacaccuucacaaauagcuacuccuuuugcgaaucuguucccaaccucgauaaauucguguuucagauggccucagcuacugacgaugcacaaaaggacaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggaugaaucauauacugaguugaagguggacguuccaaaaaucgagcaguuagcuaacuaccagcaggcagcccugaaguggaggaaggauauuggguuccgggugaaugcuaacaccgccgcgcuaagcaauaaaguccucgcagaauauaaggugccgggagagaucguaaugaguguuaaagaaaugcuguccgacaugauacgccgacguaaccaaauccuuaauagaggcggugaugagaaccccagggggccugugucucgggaacacgucgacuggugucgcgaguuugugaagggaaaauacauuauggccuucaauccacccuggggcgauaucaacaagagcggcagauccgggauugcucugguggccacaggauuggcaaaacucgcugagaccgaagguaagggcgucuuugacgaggccaagaaaacuguugaagugcugaacggguaucuggauaagcacaaagacgagguagacagggcgucagccgauaguaugaucacaaaucucuuaaagcauauagcaaaagcucaggaacuguacaagaacagcucugcccuucgggcucagggagcccagauugacaccgcauucuccucauacuauugguuguacaaggccggcgugacgccugagacuuuuccaaccgucagccaauuccuguucgagcuagguaaacagccccgcgggacaaagaaaaugaagaaagcucuccugaguacuccuaugaaguggggaaagaaacuuuaugaacuguuugcggaugacucuuuccagcagaaucgaaucuacaugcacccagcaguguugaccgccggcagaauuuccgagaugggcguuugcuuugggacaaucccgguggcuaaccccgaugacgccgcacaaggaagcggucauaccaagucgauccucaaucugaggacgaacacugaaacaaauaacccuugugcccggaccauugucaaauuauucgagauacagaagacuggcuuuaauauccaggauauggacauuguggcuucugaacaucugcuccaccaaucccuuguagggaaacagucaccauuccagaacgccuauaauguuaagggaaacgcaacaagugcgaauaucauauga

SEQ ID NO: 6033 - RNA, 1449 nt, Artificial Sequence
  derived and/or modified CDS sequence (opt3) from CCHFV(Sudan Al-Fulah 4-2008)__GQ862372.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacaaauucguguuucagauggccucagcuacugaugacgcacaaaaggauaguauuuaugccagcgcgcuuguagaggcuacgaaguucugugccccuauauacgagugcgcauggguguccucuaccggaaucgucaaaagaggucuggaaugguuugagaagaaugccggcacaauuaaaucgugggacgaaucauauacugaguugaagguggauguuccaaaaaucgagcaguuagcuaacuaccagcaggcagcccugaaguggaggaaggacauuggguuccgggugaaugcuaacaccgccgcgcuaagcaauaaaguccucgcagaauauaaggugccgggagagaucguaaugaguguuaaagaaaugcuguccgauaugauacgccgacguaaccaaauccuuaauagaggcggugacgagaaccccagggggccugugucucgggaacacgucgauuggugucgcgaguuugugaagggaaaauacauuauggccuucaauccacccuggggcgacaucaacaagagcggcagauccgggauugcucugguggccacaggauuggcaaaacucgcugagaccgaagguaagggcgucuuugaugaggccaagaaaacuguugaagcgcugaacggguaucuggacaagcauaaagacgagguggauagggccucagcagacaguaugaucacaaaucucuuaaagcacauagcuaaagcccaggaacuguacaagaacagcucugcccuucgggcucagggagcacagauugauaccgccuucuccucauacuauugguuguacaaggcuggcguaacgccugagacuuuuccaaccgugagccaauuccuguucgagcuagguaaacagccccgcgggacaaagaaaaugaagaaagcgcuccugaguacuccuaugaaguggggaaagaaacuuuaugaacuguuugcagacgauucuuuccagcagaaucgaaucuacaugcauccagccgucuugaccgcuggcagaauuuccgagaugggcgugugcuuugggacaaucccgguugccaaccccgacgaugcagcccaaggaagcggucacaccaagucgauccucaaucugaggacgaacacugaaacaaauaacccuugugcucggaccauugugaaauuauucgagauacagaagacuggcuuuucuauccaggacauggauauugucgccuccgaacaucugcuccaccaaucacuuguggggaaacagaguccauuccagaaugcauauaacguaaagggaaaugcgacaagcgcuaacaucauauga

SEQ ID NO: 6034 - RNA, 1449 nt, Artificial Sequence
  derived and/or modified CDS sequence (opt3) from CCHFV(TAJUK)__JN086996.1__N
auggagaacaagaucgaagugaauaacaaagacgagaugaauaagugguucgaagaguuuaaaaagggcaacgggcuggucgauaccuucacaaauagcuacuccuuuugcgaaucuguucccaaccucgacagauucguguuucagauggccucagcuacugaugaggcacaaaaagacaguauuuaugccagcgcgcuuguagaggcuacgaaguucugugccccuauauacgaaugcgcauggguguccucuaccggaaucgucaagaaaggucuggagugguuugaaaagaaugccggcacaauuaaaucgugggaugagucauauacugaguugaagguggaaguuccaaaaaucgagcaguuagcuaacuaccagcaggcagcccugaaguggaggaaggacauuggguuccgggugaaugcuaacaccgccgcgcuaagccacaaaguccucgcagaauauaaggugccgggagagaucguaaugaguguuaaagaaaugcuguccgauaugauacgccgacguaaucuuauccugaacagaggcggugacgagaaucccagggggccugugucucgggagcaugucgaauggugucgcgaguuugugaagggaaaauacauuauggccuucaacccacccuggggcgauaucaauaagagcggcagauccgggauugcuuugguggccacaggacucgcaaaacuggcugaaaccgaggguaagggcgucuuugacgaagccaagaaaacuguugaggcgcugaacggguaucucgauaagcacaaagacgagguggauaaggccucagcagacaacaugaucacaaauuuacugaaacauauagcuaaggcccaagaacuuuacaagaacaguagcgcuuugagggcccagggagcacagauugacaccgccuucucuuccuacuauuggcuguacaaagcuggcguaacgccugagacuuuuccaaccgugucacaguuccuauucgaacucgguaagcaaccccgggggacuaaaaagaugaaaaaggcgcugcuuagcacaccuaugaaguggggcaaaaagcuguaugaguuguuugcagaugacaguuuccagcagaaucgcaucuacaugcacccagccguccucaccgcuggacgaauuucugaaaugggcgugugcuuugggacaaucccgguugccaaccccgaugacgcagcccagggauccggucauaccaaaagcauccugaauuuaagaacgaacacugagacaaauaacccuugugcuaagaccauugugaaacuguucgagauacaaaagacuggcuuuaauauccaggauauggacauugucgccucggaacaccuccuucaccagucucugguggggaagcaauccccauuccagaacgcauauaauguaaaaggaaacgcgacaucagcuaauaucauauga

SEQ ID NO: 6035 - RNA, 1449 nt, Artificial Sequence
  derived and/or modified CDS sequence (opt3) from CCHFV(UG3010)__DQ211650.1__N
auggagaacaagaucgaagugaccagcaaagacgagaugaauagaugguucgaagaguuuaagaaauccaacggccuggucgauacauucacuaauucuuacucauuuugcgaaaguguucccaaccucgacagguucguguuucagauggccagcgcuacggaugacgcacaaaaggauuccauuuaugccucugcgcuuguagaggcuaccaaauucugugccccuauauacgagugcgcaugggugucgucaacagggaucgucaagaagggacuggaaugguuugagaaaaaugccgguacuauuaagagcugggacgaaaguuauaccgaguugaaagugggcguuccaaagaucgagcaguuagcuaacuaccagcaggcagcccugaaauggcggaaggauauuggguuccgcgugaaugcuaacacagccgcgcuauccaauaagguccucgcagaauauaaagugccgggagagaucguaaugucuguuaaggaaaugcugagcgacaugauacgacguagaaaccuuauccugaauaggggcggugaugagaacccccgggggccugugucccgcgaacacgucgagugguguagagaguuugugaaaggaaaguacauuauggccuucaauccacccuggggcgacaucaacaaaucaggcaggagugggauugcuuugguggccaccggacucgcaaagcuggcugaaacugaggguaaaggcgucuuugaugaagccaagaagacaguugaggaccugaauggguaucucgauaaacauaaggacgaaguggacaaagcgagcgccgauggaaugguaaccaacuuacugaagcacaucgcaaaagcucaagagcuuuacaagaacucuuccgccuugcgggcucagggcgcccagauagacacgccuuucagcucauuuuacuggcuguauaaggccggugugaguccagagacuuuccccaccgucucucaguuccuauuugaacucgggaaacaaccucgcggaacaaagaaaaugaagaaagcacugcuuuccacuccaaugaaguggggcaagaaacuguacgaguuguucgcugaugacagcuuucaggaaaaucgaauuuauaugcauccggcggugcucaccgcaggcagaaucucggagauggggguuugcuucggaacaauucccguggccaacccugaugacgcugcccaggguucuggccacaccaaguccauccugaauuuaaggacgaacacugaaacaaauaacccaugugcaaaaaccaucgucaagcuguuugagauucagaaaacuggguucaauauacaagauauggacaucguggccucagagcaucuccuucaccagagucugguaggaaagcagagccccuuucaaaacgcuuacaauguuaagggcaacgccacauccgcaaauauuaucuga

SEQ ID NO: 6036 - RNA, 1449 nt, Artificial Sequence
  derived and/or modified CDS sequence (opt3) from CCHFV(UGANDA 3010)__U88416.1__N
auggagaacaagaucgaagugaccagcaaagacgagaugaauagaugguucgaagaguuuaagaaauccaacggccuggucgauacauucacuaauucuuacucauuuugcgaaaguguucccaaccucgacagguucguguuucagauggccagcgcuacggaugacgcacaaaaggauuccauuuaugccucugcgcuuguagaggcuaccaaauucugugccccuauauacgagugcgcaugggugucgucaacagggaucgucaagaagggacuggaaugguuugagaaaaaugccgguacuauuaagagcugggacgaaaguuauaccgaguugaaagugggcguuccaaagaucgagcaguuagcuaacuaccagcaggcagcccugaaauggcggaaggauauuggguuccgcgugaaugcuaacacagccgcgcuauccaauaagguccucgcagaauauaaagugccgggagagaucguaaugucuguuaaggaaaugcugagcgacaugauacgacguagaaaccuuauccugaauaggggcggugaugagaacccccgggggccugugucccgcgaacacgucgagugguguagagaguuugugaaaggaaaguacauuauggccuucaauccacccuggggcgacaucaacaaaucaggcaggagugggauugcuuugguggccaccggacucgcaaagcuggcugaaacugaggguaaaggcgucuuugaugaagccaagaagacaguugaggaccugaauggguaucucgauaaacauaaggacgaaguggacaaagcgagcgccgauggaaugguaaccaacuuacugaagcacaucgcaaaagcucaagagcuuuacaagaacucuuccgccuugcugcuacagggcgcucagauagacacgccuuucagcucauuuuacuggcucuauaaggccggugugaguccagagacuuuccccaccgucucucaguuccuguuugaacuugggaaacaaccucggggaacaaagaaaaugaagaaagcacuguuguccacuccaaugaaguggggcaagaaacucuacgagcuguucgccgaugacagcuuucaggaaaaucgcauuuauaugcauccggcuguguuaaccgcgggccgaaucucggagauggggguuugcuucggaacaauucccguggcaaacccugaugacgccgcucaggguucuggccacaccaaguccauccugaaucucgggacgaacacugaaacaaauaacccaugugccaaaaccaucgucaaacuuuuugagauucagaagacuggauucaauauacaagauauggacaucguggcaucagagcaucuguugcaccagagucuaguaggcaagcagagccccuuucaaaacgccuacaauguuaaggguaacgcuacauccgccaauauuaucuga

SEQ ID NO: 6037 - RNA, 1449 nt, Artificial Sequence
  derived and/or modified CDS sequence (opt3) from CCHFV(UK ex Bulgaria)__KM201260.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgagauucugugccccuauauacgagugcgcauggguauccucuaccggaaucgugaagaaaggucuggaaugguuugagaaaaauucgggcacaauuaaaucaugggacgaaaacuaugccgaguugaaggucgaugugccaaaaaucgagcaguuagcuaauuaccagcaggcagcccugaaguggaggaaggacauuggguuccggguuaacgcuaauacugccgcgcuaagcaacaaagugcucgcagaauauaaggucccgggagagaucgugaugaguguaaaagaaaugcuguccgauaugauacgccgacguaaucuuauccugaacagaggcggugacgagaaucccagggggccuguuucucgggaacacguggaguggugucgcgaguuugucaagggaaaauacauuauggccuucaacccacccuggggcgauaucaacaagagcggcagauccgggauugcuuugguggccaccggacucgcaaaacuggcugaaacagaggguaagggcguguuugacgaagccaagaaaaccgucgaggcgcugaauggguaucucgauaagcauagggacgaaguugacaaagccucagcagauaguaugaucacuaacuuacugaagcacauagcuaaagcccaagagcuuuacaagaauagcucugcuuugcgggcccagggagcacagauugacacaccuuucuccucauuuuacuggcuguauaaggccggcgugaccccagagacguuccccacuaucagccaguuccuauuugaacucgguaaacaaccucgcgggaccaagaaaaugaagaaagcucugcuuaguacaccaaugaaguggggaaagaaacuguacgaguuguucgcggaugacucuuuucagcagaaccgaauuuauaugcauccggcaguacucacugccggcagaaucuccgaaaugggcgugugcuucgggaccauccccgucgcuaauccugaugacgccgcacagggaagcggucacacaaagucgauucugaacuuaaggaccucuacggagacuaauaacccaugugccaaaacaauagugaagcuguuugaaauccaaaagaccggcuucaauauucaggauauggacaucguugcuuccgagcaucuccuucaccagucacugguggggaagcaaagucccuuucagaacgccuacaaugucaagggaaacgcaacuagcgcgaauauaauuuga

SEQ ID NO: 6038 - RNA, 1449 nt, Artificial Sequence
  derived and/or modified CDS sequence (opt3) from CCHFV(Yozgat19-2012)__KR092375.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguucuggcgacgagaaucccagagguccuguuagcagggaacacguggaguggugucgggaguuugucaaagggaaguacauuauggccuucaacccacccuggggagauaucaacaaauccggccgcucaggcauugcuuugguggccaccgggcucgcaaagcuggcugaaacagagggaaaggguguguuugacgaagccaaaaagaccgucgaggcgcugaauggcuaucucgauaaacauagagacgaaguugacaaggccagugcagauagcaugaucacuaacuuacugaaacacauagcuaaggcccaagagcuuuacaagaauagcuccgcuuugagggcccagggggcacagauugacacaccuuucucaucuuuuuacuggcuguauaaagccggagugaccccagagacguuccccacuaucagucaguuccuauuugaacucggcaagcaaccucgggguaccaaaaagaugaaaaaggcucugcuuucuacaccaaugaagugggggaaaaagcuguacgaguuguucgcggaugacuccuuucagcagaaccgcauuuauaugcauccggcaguacucacugccggacgaaucagcgaaaugggcgugugcuucggcaccauccccgucgcuaauccugaugacgccgcacaggggucgggacacacaaaaucuauucugaacuuaagaaccuccacggagacuaauaacccaugugccaagacaauagugaaacuguuugaaauccaaaagaccgguuucaauauucaggauauggacaucguugcuucagagcaucuccuucaccagagucuggugggcaagcaaagccccuuucagaacgccuaccacgucaaagggaaugcaacuuccgcgaacauaauuuga

SEQ ID NO: 6039 - RNA, 1449 nt, Artificial Sequence
  derived and/or modified CDS sequence (opt3) from CCHFV(Yozgat207-2011)__KR092377.1__N
auggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaaaauucgggcacaauuaagucaugggacgaaaacuaugccgaguugaaagucgaugugccaaagaucgagcaguuagcuaauuaccagcaggcagcccugaaguggagaaaagacauuggguucaggguuaacgcuaauacugccgcgcuaagcaacaaggugcucgcagaauauaaagucccgggagagaucgugaugaguguaaaggaaaugcuguccgauaugauacggcgccgaaaucuuauccugaaccguggcggugacgagaaucccagagggccuguuucuagggaacacguggaguggugucgggaguuugucaaaggaaaguacauuauggccuucaacccacccuggggcgauaucaacaaaagcggccgcuccgggauugcuuugguggccaccggacucgcaaagcuggcugaaacagaggguaagggcguguuugacgaagccaaaaagaccgucgaggcgcugaauggguaucucgauaaacauagagacgaaguugacaaggccucagcagauaguaugaucacuaacuuacugaaacacauagcuaaggcccaagagcuuuacaagaauagcucugcuuugagggcccagggagcacagauugacacaccuuucuccucauuuuacuggcuguauaaagccggcgugaccccagagacguuccccacuaucagccaguuccuauuugaacucgguaagcaaccucgggggaccaaaaagaugaaaaaggcucugcuuaguacaccaaugaaguggggcaaaaagcuguacgaguuguucgcggaugacucuuuucagcagaaccgcauuuauaugcauccggcaguacucacugccggacgaaucuccgaaaugggcgugugcuucgggaccauccccgucgcuaauccugaugacgccgcacagggaagcggucacacaaaaucgauucugaacuuaagaaccucuacggagacuaauaacccaugugccaagacaauagugaaacuguuugaaauccaagagaccggcuucaauauucaggauauggacaucguugcuuccgagcaucuccuucaccagucacugguggggaagcaaagucccuuucagaacgccuacaaugucaagggaaacgcaacuagcgcgaauauaauuuga

SEQ ID NO: 6040 - RNA, 1452 nt, Artificial Sequence
  derived and/or modified CDS sequence (opt3) from DUGV(ArD44313)__AF434161.1__N
auggagaaccagaucaaggccaauaacaaaaaggaguucgacgaaugguuuaaacccuucagcgaaaagcugcaacucagauccaaucuuaccaacucugcuucacugugcgauagggugccugacuuggcauuagccgagaugaaaauggcgcuggcuacagaugacaaggaaaaggauaguauuuuuagcaaugcccuagucgaggcaacucgguucugugccccaauauacgagugcgcuuggacguguuccaccggcguugugcagaaaucucucucgugguuugacaagaacaaagauuucaucaagcugugggacgcaaaauauauggaucuuaagaaggggauuccggaacccgagcagcugguaucauaccagcaagccgcucagaaauggcgcaaggacgugggauaugaaaucaaucaguuuacacguagcuugacucacccugucguggccgaguacaaaguuccaggugagauugcgguggaugucaaggaaaugcucagugacaugauccgaagaaggaacgugcugcugaauggcgauggggagaacgcaggcaaaaagggacccauaucccgggaacauguaucuuggggucgcgagcucgccgggggaaaauuccagguuguguuuaauccuccauggggcgacaucaacaagugcggcaagagcgggauucccuuagcugccaccgcaauggucaaaguggcugaacuggacggauccaagaaacuugaggauaucagacaagccuugcuggaccuaaagaaauggguggaggauaauaaggacgcgcucgaagaugguaagggcaacgagcugguccagacaaugaccaaacaccuugcccaggcaguugaacugucaaagaaaaguaaugcuuugagggcccagggggcucaaauugacacuccuuucagcgccuauuacugggcauggucugccggagugaagccagagacauuuuucacccucucccaguuucuguucgaaaugggccagucagcucggggugggaaaaagaugaucaaggcguuaacgagcacuccgcugcgcuggggaaaaggccucauaaaccuuuucgcagaugacgauuuucugggcaaccgauuguauaugcaucccgccguacuaaccccugggagaaugagugagaugggagcuuguuucggugugauuccagucgccucucccgaggacgcaauccugggcuccgggcacagcaagaauauucucaacuuuaaaaucgauacaucggugcaaaauccuugcgccucuacuaucguucagcuguacaggauucagaaguccggauucgaccuugaaucacuggagguggucaguaccgaacauuugcuccaccagagcuuugugggcaaacgguguccaacacaaaacgcuuacaagguacgugguaaugccaccaacguuaauauaaucuga

SEQ ID NO: 6041 - RNA, 1452 nt, Artificial Sequence
  derived and/or modified CDS sequence (opt3) from DUGV(ArD16095)__AF434162.1__N
auggagaaccagaucaaggccaauaacaaaaaggaguucgacgaaugguuuaaacccuucagcgaaaagcugcaacucagauccaaucuuaccaacucugcuucacugugcgauagggugccugacuuggcauuagccgagaugaaaauggcgcuggcuacagaugacaaggaaaaggauaguauuuuuagcaaugcccuagucgaggcaacucgguucugugccccaauauacgagugcgcuuggacguguuccaccggcguugugcagaaaucucucucgugguuugacaagaacaaagauuucaucaagcugugggacucaaaauauauggaucuucgcaaggggauuccggaacccgagcagcugguaagcuaccagcaagcagcccagaaguggcgaaaagacgugggauaugaaaucaaucaguuuacacguaguuugacucacccugucguggcugaguacaagguuccaggugagauugccguggaugucaaagaaaugcucuccgacaugaucagaaggcggaacgugcugcugaauggcgauggggagaacgcgggaaagaaaggccccauaucucgcgaacauguaagcugggguagagagcucgcagggggaaaguuccagguuguguuuaauccuccauggggcgacaucaacaaaugcggcaaguccgggauucccuuagccgcuaccgccauggucaagguggcagaacuggacggaucaaagaaacuugaggauaucaggcaagcucuacuggacuugaaaaaguggguggaggauaauaaagacgcccucgaagaugguaagggcaacgagcugguccagacaaugaccaagcaccuugcgcaggccguugaacugaguaaaaagagcaaugcauugcgggcucagggggcccaaauugacacuccuuucucugcuuauuacugggccugguccgcaggagugaaaccagagacauuuuucacccucucacaguuucuguucgaaaugggccagagcgcccgcggugggaagaaaaugaucaaggcuuuaacgaguacuccgcugcgauggggaaagggccucauaaaccuuuucgcggaugacgauuuuucuggcaacagacuguauaugcaucccgcaguauugaccccugggaggauguccgagaugggagccuguuucggugugauuccagucgcuagccccgaggacgccauccuaggcucggggcacucuaaaaauauucugaacuuuaagaucgauacauccgugcaaaauccuugcgcaucaacuaucguucagcucuaccggauucagaaaaguggauucgaccuggaaagccuugagguggucuccaccgaacaucuguugcaccagucuuuugugggcaagcguuguccaacacaaaacgccuacaaaguacgcgguaaugcuaccaacguuaauauaaucuga

SEQ ID NO: 6042 - RNA, 1452 nt, Artificial Sequence
  derived and/or modified CDS sequence (opt3) from DUGV(IbH11480)__AF434163.1__N
auggagaaccagaucaaggccaauaacaaaaaggaguucgacgaaugguuuaaacccuucagcgaaaagcugcaacucagauccaaucuuaccaacucugcuucacugugcgauagggugccugacuuggcauuagccgagaugaaaauggcgcuggcuacagaugacaaggaaaaggauaguauuuuuagcaaugcccuagucgaggcaacucgguucugugccccaauauacgagugcgcuuggacguguuccaccggcguugugcagaaaucucucucgugguuugacaagaacaaagauuucaucaagcugugggacgcaaaauauauggaucuucgcaaggggauuccggaacccgagcagcugguaucauaccagcaagccgcucagaaguggcgaaaagacgugggauaugaaaucaaucaguuuacacguagcuugacucacccugucguggccgaguacaagguuccaggugagauugcgguggaugucaaagaaaugcucagugacaugaucagaaggcggaacgugcugcugaauggcgauggggagaacgcaggaaagaaaggccccauaucccgcgaacauguaucuugggguagagagcucgccgggggaaaguuccagguuguguuuaauccuccauggggcgacaucaacaaaugcggcaagagcgggauucccuuagcugccaccgcaauggucaagguggcugaacuggacggauccaaaaagcuagaggauaucaggcaagccuugcuggaccuuaaaaaguggguggaggauaauaaagacgcgcucgaagaugguaagggcaacgagcugguccagacaaugaccaagcaccuugcccaggcaguugaacugaguaaaaagucaaaugcuuugcgggcccagggggcucaaauugacacuccuuucagcgccuuuuauugggcauggucugccggagugaaaccagagacauucuuuacccucucccaguuccuguucgaaaugggccagucagcucgcggugggaagaaaaugaucaaggcguuaacgagcacuccgcugcgauggggaaagggccucauaaaccuuuuugcagaugacgauuuccugggcaacagauuguacaugcaucccgccguacuaaccccugggaggaugagugagaugggagcuuguuuuggugugauuccagucgccucucccgaggacgcaauccugggcuccgggcacagcaaaaauauucucaacuucaagaucgauacaucggugcaaaauccuugcgccucuacuaucguucagcuguaucggauucagaaauccggauuugaccuugaaucacuggagguggucaguaccgaacauuugcuccaccagagcuucgugggcaagcguuguccaacacaaaacgcuuacaaaguacgcgguaaugccaccaacguuaauauaaucuga

SEQ ID NO: 6043 - RNA, 1452 nt, Artificial Sequence
  derived and/or modified CDS sequence (opt3) from DUGV(IbAr1792)__AF434164.1__N
auggagaaccagaucaaggccaauaacaaaaaggaguucgacgaaugguuuaaacccuucagcgaaaagcugcaacucagauccaaucuuaccaacucugcuucacugugcgauagggugccugacuuggcauuagccgagaugaaaauggcgcuggcuacagaugacaaggaaaaggauaguauuuuuagcaaugcccuagucgaggcaacucgguucugugccccaauauacgagugcgcuuggacguguuccaccggcguugugcagaaaucucucucgugguuugacaagaacaaagauuucaucaagcugugggacgcaaaauauauggaucuucgcaaggggauuccggaacccgagcagcugguaucauaccagcaagccgcucagaaguggcgaaaagacgugggauaugaaaucaaucaguuuacacguagcuugacucacccugucguggccgaguacaagguuccaggugagauugcgguggaugucaaagaaaugcucagugacaugaucagaaggcggaacgugcugcugaauggcgauggggagaacgcaggaaagaaaggccccauaucccgcgaacauguaucuugggguagagagcucgccgggggaaaguuccagguuguguuuaauccuccauggggcgacaucaacaaaugcggcaagagcgggauucccuuagcugccaccgcaauggucaagguggcugaacuggacggauccaaaaagcuagaggauaucaggcaagccuugcuggaccuuaaaaaguggguggaggauaauaaagacgcgcucgaagaugguaagggcaacgagcugguccagacaaugaccaagcaccuugcccaggcaguugaacugaguaaaaagucaaaugcuuugcgggcccagggggcucaaauugacacuccuuucagcgccuauuacugggcauggucugccggagugaaaccagagacauuuuucacccucucccaguuucuguucgaaaugggccagucagcucgcggugggaagaaaaugaucaaggcguuaacgagcacuccgcugcgauggggaaagggccucauaaaccuuuucgcagaugacgauuuucugggcaacagauuguauaugcaucccgccguacuaaccccugggaggaugagugagaugggagcuuguuucggugugauuccagucgccucucccgaggacgcaauccugggcuccgggcacagcaaaaauauucucaacuuuaagaucgauacaucggugcaaaauccuugcgccucuacuaucguucagcuguaccggauucagaaauccggauucgaccuugaaucacuggagguggucaguaccgaacauuugcuccaccagagcuuugugggcaagcguuguccaacacaaaacgcuuacaaaguacgcgguaaugccaccaacguuaauauaaucuga

SEQ ID NO: 6044 - RNA, 1452 nt, Artificial Sequence
  derived and/or modified CDS sequence (opt3) from DUGV(KT281/75)__AF434165.1__N
auggagaaccagaucaaggccaauaccaaaaaggaguucgacgaaugguuuaaacccuucagcgauaagcugcaacucagauccacacuuacuaacucugcuucacugugcgacagggugccugauuuggcauuagccgaaaugaaaauggcgcuggcuacggacgauaaggagaaggacaguauuuuuagcaaugcccuagucgaagcaacccgguucugugccccaauauacgagugcgcuuggacauguuccacuggcguugugcagaaaucucucucgugguuugauaagaacaaagacuucaucaagcugugggaugcaaaauauauggaccuucgcaaggggauuccggagcccgaacagcugguaucauaccagcaagccgcucagaaguggcgaaaagauaucggauaugagauuaaucaguuuacccguagcuugacacacccuguggucgccgaauacaaggugccaggugagaucgcgguugacgugaaagagaugcucagugauaugauaagaaggcggaacguccugcugaauggcgacggggaaaacgcaggaaagaaaggccccaucucccgcgagcaugugucuugggguagagaacucgccgggggaaaguuccagguaguuuuuaauccuccauggggcgacauuaacaaaugcggcaagagcgggauccccuuagcugccaccgcaauggugaaggucgcugagcuggauggauccaaaaagcuagaagacauuaggcaagccuugcuggaucuuaaaaaguggaucgaggacaauaaagaugcgcucgaggacgguaagggcaacgaacugauacagacuaugacaaagcaccuugcccaggcaguggagcugaguaaaaagucaaaugcuuugcgggcccagggggcucaaauugauaccccuuucagcgccuuuuauugggcauggucugccggagugaaaccagaaacguucuuuacucucucccaguuccuguucgagaugggccagucagcucgcggugggaagaaaaugaucaaggcguuaaccagcacaccgcugcgauggggaaagggccucauuaaccuuuuugcagacgaugacuucaguggcaauagacuguacaugcaucccgccgucuugacuccugggaggaugucugaaaugggagcuuguuuugguguuaucccaguggccucccccgaggaugcaauccuaggcagcgggcacucgaaaaacauucugaacuucaagauagacaccucuguacaaaauccuugcgccuccacaaucgugcagcucuaucggauucagaaaucaggauuugaccuggagagucuugaagucgugagcaccgagcaucuguugcaccaguccuucguuggcaagcguuguccaacgcaaaacgcuuacaaagugcgcgguaaugccacuaacgucaauaucauauga

SEQ ID NO: 6045 - RNA, 1452 nt, Artificial Sequence
  derived and/or modified CDS sequence (opt3) from DUGV(NJT130)__FJ422213.2__N
auggagaaccagaucaaggccaauaacaaaaaggaguucgacgaaugguuuaaacccuucagcgauaagcugcaacucagauccacccuuacaaauucugcuucacugugcgacaaagugccugauuuggcauuagccgaaaugaagauggcgcuggcuacugacgauaaggagaaagacaguauuuuuagcaacgcccuagucgaagcaacgagguucugugccccaauauacgagugcgcuuggaccuguuccacaggcguugugcagaagucucucucgugguuugauaaaaauaaggacuucaucaaacugugggaugcaaaguauauggaccuucggaaggggauuccggagcccgaacagcugguaucauaccagcaagccgcucagaaauggcgcaaggauaucggauaugagauuaaccaguuuacucguagcuugacccacccuguggucgccgaauacaaagugccaggugagaucgcgguugacgugaaggagaugcucagugauaugauacgaagaaggaauguccugcugaacggcgacggggaaaaugcaggcaaaaagggacccaucucccgggagcaugugucuuggggucgcgaacucgccgaggggaaauuccagguaguuuuuaacccuccauggggagacauuaauaagugcggcaagagcggcauccccuuagcugccacagcaauggugaaagucgcugaacuggauggguccaagaaacuugaggacauuagacaagccuugcuggaucuaaagaaauggguggaggacaacaaggaugcgcucgaagacggaaaggguaaugagcugauccagaccaugacuaaacaccuugcccaggcaguggaacugucaaagaaaaguaacgcuuugagggcccagggcgcucaaauagauacaccuuucagcgccuuuuauugggcauggucugccggggucaagccagagaccuucuuuacgcucucccaguuccuguucgaaaugggacagucagcucggggcgguaaaaagaugauuaaggcguuaacuagcaccccgcugcgcugggggaaaggacucaucaaucuuuuugcagacgaugacuucaguggcaaccgacuguacaugcaucccgccguuuugacaccuggcagaaugucugagaugggggcuuguuuuggagugauuccaguagccucccccgaggaugcaauccuagguagcggccacucgaagaacauccugaauuucaaaauugacacuucugugcaaaacccuugcgccuccaccauaguccagcucuauaggauccagaagucaggguuugaccuggaaagucuugaggugguuagcacagaacaucuguugcaccaguccuucgugggaaaacgguguccaacccaaaaugcuuacaagguccguggcaacgccacgaaugugaacauuaucuga

SEQ ID NO: 6046 - RNA, 1452 nt, Artificial Sequence
  derived and/or modified CDS sequence (opt3) from DUGV(IbAr1792)__KU925457.1__N
auggagaaccagaucaaggccaauaacaaaaaggaguucgacgaaugguuuaaacccuucagcgaaaagcugcaacucagauccaaucuuaccaacucugcuucacugugcgauagggugccugacuuggcauuagccgagaugaaaauggcgcuggcuacagaugacaaggaaaaggauaguauuuuuagcaaugcccuagucgaggcaacucgguucugugccccaauauacgagugcgcuuggacguguuccaccggcguugugcagaaaucucucucgugguuugacaagaacaaagauuucaucaagcugugggacgcaaaauauauggaucuucgcaaggggauuccggaacccgagcagcugguaucauaccagcaagccgcucagaaguggcgaaaagacgugggauaugaaaucaaucaguuuacacguagcuugacucacccugucguggccgaguacaagguuccaggugagauugcgguggaugucaaagaaaugcucagugacaugaucagaaggcggaacgugcugcugaauggcgauggggagaacgcaggaaagaaaggccccauaucccgcgaacauguaucuugggguagagagcucgccgggggaaaguuccagguuguguuuaauccuccauggggcgacaucaacaaaugcggcaagagcgggauucccuuagcugccaccgcaauggucaagguggcugaacuggacggauccaaaaagcuagaggauaucaggcaagccuugcuggaccuuaaaaaguggguggaggauaauaaagacgcgcucgaagaugguaagggcaacgagcugguccagacaaugaccaagcaccuugcccaggcaguugaacugaguaaaaagucaaaugcuuugcgggcccagggggcucaaauugacacuccuuucagcgccuuuuauugggcauggucugccggagugaaaccagagacauucuuuacccucucccaguuccuguucgaaaugggccagaacgcucgcggugggaagaaaaugaucaaggcguuaacgucaacuccgcugcgauggggaaagggccucauaaaccuuuuugcagaugacgauuuccugggcaauagauuguacaugcaucccgccguacuaaccccugggaggaugagcgagaugggagcuuguuuuggugugauuccagucgccagucccgaggacgcaauccugggcucugggcacuccaaaaacauucucaauuucaagaucgauacaagcgugcaaaacccuugcgccucgacuaucguucagcuguaucggauucagaaaucuggauuugaccuugaaucccuggagguggucucaaccgaacauuugcuccaccagaguuucgugggcaagcguuguccaacacaaaaugcuuacaaaguacgcgguaacgccaccaauguuaacauaaucuga

SEQ ID NO: 6047 - RNA, 1449 nt, Artificial Sequence
  derived and/or modified CDS sequence (opt3) from NSDV(Jilin)__NC_034386.1__N
augcagaaccaaaucguggccgacaauaaggaugcuauucuggcauggcacaaaaccuacagcgagaagcauagacucaaauccguccuuacaaacucugccucauucugcgaaacuauacccgaccugaguggcuaugagguuagcaugagguugguguccucugaaucggagaaggauucaguauacgcgagcgcuuuaguggccgcaacgaaauuuugugccccuauccuggaaugcgcuuggaccaguuguacagggauggucgagcggggacuagacugguucgagaauaacaaggaaacugugaagauuugggaugcagaguaugguaaacuccgcaccgaagccccauccccggagcagcugcuuggcuaccagcgagcugcccugaaguggcguaaagacacaaaguaugggaucaauagaaacaccgcggcauuggccgcugccauugcaacugaguacaggguucccggaucuaucguggucaaugugaaagauaugcucagcgacaugauacggcgcagaaacaagauccugaauagggauggcuccgaagacguaccuaagcgggguccaguuucaaaagagcacauugauugggcucgcgaccuggcccaggggaaguuucucguggucuucaaucccccuuggggagauaucaacaaagcgggcaagaguggcauugccuuagcagcuacagggauggccaaacugaucgaacuugacggaccaaagauagcugaggacuugcgagaaagccugaaaggucuaguggccuggauuaacgcacauaaggaugagguggagaauggcaaggaagucguugacgggcucaccaaacaucugcaaaaggcccuugagcuggcuaaacagucuuccgcgaugagagcacagggagcccagaucgauacgguguuuucaagcuauuacugguuguggaaggcuggcguaacugccgaaauguuccccaccgugagucaauuucucuucgagcuggguaaagucccuagggggaacaagaagaugaaaaaggcauuaucuuccaugccacugaaauggggaaagaaacuccuugcccuguuugcugacgauagcuucacagccaaucggauuuacaugcacccgggcguguugacugcaggccguaugucggaacuagggguuugcuuuggagcgauccccguggcuaacccugacgaugccgcagaggguucuggccacaucaagaacauucuggcccagaccacagacacccaggcugggaauccaugugcccagaacauagucgcacucuucaauauccaaaaggcuggauuugauauugaguccauggacaucguggcccuggaacaccuucugcaucagucauugguaggcaaacgcagucccuuccagaacgcguauaauauaagagguaacgccacgagcauucaaaucaucuga

SEQ ID NO: 6048 - RNA, 1449 nt, Artificial Sequence
  derived and/or modified CDS sequence (opt3) from NSDV(62873)__HQ286609.1__N
augcagaaccaaaucguggccgacaauaaggaugcuauucuggcauggcacaaaaccuacagcgagaagcauaaacucaaguccguccuuacaaacucugccucauucugcgaaacuauacccgaccugaguggcuaugagguuagcaugagauugguguccucugaaucggagaaagauucaguauacgcgagcgcuuuaguggccgcaacgaaguuuugugccccuauccuggaaugcgcuuggaccaguuguacagggaugauucagaggggacuagacugguucgagaauaacggugagauggucaagaucugggaugcagacuauggcaaacuccggacugaaauuccauccccggagcagcugcuuggguaccagcgcgccgcucugaaguggcgaaaagauaccaaguauggaaucaauaaaaacacagccgcguuggcagccgcuauagccaccgaauaccgugugcccggcucuaucguugugaaugucaaggacaugcucagcgauaugauuagaaggcggaacaagauccugaaucgcgacgguuccgaggaugugccuaaaagagggccaguaucaaaggagcacauugacugggcaagggaucuggcucaaggaaaauuucucguuguguucaaucccccuuggggcgacaucaacaaggccggcaaaagugggauagcguuagccgcaacuggaauggcuaagcugauugaacuugacgguccaaaagucgccgaggauuugaaggaaagccugaagucucuaguggcuuggaucaacgcccauaaagacgagguggaaaauggcaaggaggucguugaugggcucacaaaacaucugcagaaggcacuugagcuggccaaacaguccucagcuaugcgggcgcagggagcacaaauugacaccguguuuagcaguuauuacugguuguggaaggccggcguaacggcugaaauguuccccacugugucucaguuucucuucgagcuggguaaggucccucgcgggaacaaaaagaugaaaaaggccuuauccagcaugccacugaaauggggaaagaagcuccuugcacuguuugccgaugacucguucaccgcuaaucgaaucuacaugcacccgggcguguugacagccggcagaaugucugaacuagggguuugcuuuggagcaauccccguggcgaacccugaugacgcugccgaggguuccggccacauuaaaaacauacugaauuauaagacugauacccaggcagggaacccaugugcccagaauaucgucgcucucuucaacauucaaaaagccggauuugacaucgaaucaauggauauaguggcaagugagcaucugcuucaccagagccugguaggcaagaggucccccuuccagaaugcuuacaacauucgggguaaugccacaucuauccaaaucauuuga

SEQ ID NO: 6049 - RNA, 1449 nt, Artificial Sequence
  derived and/or modified CDS sequence (opt3) from NSDV(779)__HQ286602.1__N
augcagaaccaaaucguggccgacaauaaggaugcuauucuggcauggcacaaaaccuacagcgagaagcauaaacucaaguccguccuuacaaacucugccucauucugcgaaacuauacccgaccugaguggcuaugagguuagcaugagauugguguccucugaaucggagaaagauucaguauacgcgagcgcuuuaguggccgcaacgaaguuuugugccccuauccuggaaugcgcuuggaccaguuguacagggaugauucagaggggacuagacugguucgauaauaacggugagauggucaagaucugggacgcagauuauggcaaacuccggacugaggugccauccccggaacagcugcuuggguaccagcgcgccgcucugaaguggcgaaaagacaccaaguauggaauuaauaaaaacacagccgcguuggcagccgcuaucgccaccgaguaccguguucccggcucuauaguggucaaugugaaggauaugcucagcgacaugaucagaaggcggaacaagauucugaaucgcgaugguuccgaagacguaccuaaaagagggccaguuucaaaggagcacaucgauugggcaagggaccuggcucaaggaaaauuucucguggucuucaaucccccuuggggcgacauuaacaaggccggcaaaagugggaucgcguuagccgcaacuggaauggcuaagcugauagagcuugaugguccaaaaguggccgaagacuugaaggagagccugaagucucuaguggcuuggauuaacgcccauaaagaugaagucgagaauggcaaggaaguuguggacgggcucacaaaacaucugcagaaggcacuugagcuggccaaacaguccucagcuaugcgggcgcagggagcacaaaucgauaccguauuuagcaguuauuacugguuguggaaggccggcgugacggcugagauguuccccacugucucucaguuucucuucgaacuggguaaggugccucgcgggaacaaaaagaugaaaaaggccuuauccagcaugccacugaaauggggaaagaagcuccuugcacuguuugccgacgauucguucaccgcuaaucgaauuuacaugcacccgggcguuuugacagccggcagaaugucugagcuaggggugugcuuuggagcaauccccgucgcgaacccugacgaugcugccgaagguuccggccacaucaaaaacauucugaauuauaagacugacacccaggcagggaacccaugugcccagaauauaguggcucucuucaacauccaaaaagccggauuugauauugagucaauggacaucguagcaagugaacaucugcuucaccagagccugguuggcaagaggucccccuuccagaaugcuuacaacauacgggguaaugccacaucuauucaaaucaucuga

SEQ ID NO: 6050 - RNA, 1449 nt, Artificial Sequence
  derived and/or modified CDS sequence (opt3) from NSDV(6233)__HQ286603.1__N
augcagaaccaaaucguggccgacaauaaggaugcuauucuggcauggcacaaaaccuacagcgagaagcauaaacucaaguccguccuuacaaacucugccucauucugcgaaacuauacccgaccugaguggcuaugagguuagcaugagauugguguccucugaaucggagaaagauucaguauacgcgagcgcuuuaguggccgcaacgaaguuuugugccccuauccuggaaugcgcuuggaccaguuguacagggaugauucagaggggacuagacugguucgauaauaacggugagauggucaagaucugggacgcagauuauggcaaacuccggacugaggugccauccccggaacagcugcuuggguaccagcgcgccgcucugaaguggcgaaaagacaccaaguauggaauuaauaaaaacacagccgcguuggcagccgcuaucgccaccgaguaccguguucccggcucuauaguggucaaugugaaggauaugcucagcgacaugaucagaaggcggaacaagauucugaaucgcgaugguuccgaagacguaccuaaaagagggccaguuucaaaggagcacaucgauugggcaagggaccuggcucaaggaaaauuucucguggucuucaaucccccuuggggcgacauuaacaaggccggcaaaagugggaucgcguuagccgcaacuggaauggcuaagcugauagagcuugaugguccaaaaguggccgaagacuugaaggagagccugaagucucuaguggcuuggauuaacgcccauaaagaugaagucgagaauggcaaggacguuguggaugggcucacaaaacaucugcagaaggcacuugaacuggccaaacaguccucagcuaugcgggcgcagggagcacaaaucgacaccguauuuagcaguuauuacugguuguggaaggccggcgugacggcugagauguuccccacugucucucaguuucucuucgagcuggguaaggugccucgcgggaacaaaaagaugaaaaaggccuuauccagcaugccacugaaauggggaaagaagcuccuugcacuguuugccgaugacucguucaccgcuaaucgaauuuacaugcacccgggcguuuugacagccggcagaaugucugaacuaggggugugcuuuggagcaauccccgucgcgaacccugaugacgcugccgaggguuccggccacaucaaaaacauucugaauuauaagacugauacccaggcagggaacccaugugcccagaauauaguggcucucuucaacauccaaaaagccggauuugacauugaaucaauggacaucguagcaagugagcaucugcuucaccagagccugguuggcaagaggucccccuuccagaaugcuuacaacauacgggguaaugccacaucuauucaaaucaucuga

SEQ ID NO: 6051 - RNA, 1449 nt, Artificial Sequence
  derived and/or modified CDS sequence (opt3) from NSDV(40350)__HQ286608.1__N
augcagaaccaaaucguggccgacagcaaggaugcuauucuggcauggcacaaaaccuacuccgagaagcauaaacucaagucuguccuuacaaauucagccaguuucugcgaaacuauacccgaccugagcggcuaugagguuuccaugagauuggugucuucggauucagaaaaagacagcguauacgcgagugcuuuaguggccgcaacgaaguuuugugccccuauccuggagugcgcuuggaccuccuguacagggaugauucagaggggacuagauugguucgaaaacaauggugagauggucaagaucugggacgcagauuauggcaaacuccggacugaggugccaucuccggaacagcugcuuggguaccagcgcgccgcucugaaguggcgaaaagacaccaaguauggaauuaacaaaaauacagccgcguuggcagccgcuaucgccaccgaguaccguguucccggcagcauaguggucaacgugaaggauaugcucuccgacaugaucagaaggcggaauaagauucugaaccgcgaugguucagaagacguaccuaaaagagggccaguuaguaaggagcacaucgauugggcaagggaccuggcucaaggaaaauuucucguggucuucaaucccccuuggggcgacauuaacaaggccggcaaaagcgggaucgcguuagccgcaacuggaauggcuaagcugauagagcuugaugguccaaaaauugccgaagacuugaaggagucucugaagucccuaguggcuuggaucaaugcccauaaagaugaaguggagaacggcaaggaagucguugacgggcucacaaaacaucugcagaaggcacuugagcuggccaaacagucaagcgcuaugcgggcgcagggagcacaaauugauaccguguuuaguucuuauuacugguuguggaaggccggcguaacggcugagauguuccccacugugucccaguuucucuucgaacuggguaaggucccucgcgggaauaaaaagaugaaaaaggccuuaagcucgaugccacugaaauggggaaagaagcuccuugcacuguuugccgacgauucuuucaccgcuaaccgaaucuacaugcacccgggcguguugacagccggcagaauguccgagcuagggguuugcuuuggagcaauccccguggcgaauccugacgaugcugccgaagguucaggccacauuaaaaacauacugaacuauaagacugacacccaggcagggaauccaugugcccagaacaucgucgcucucuucaauauucaaaaagccggauuugauaucgagaguauggacauaguggcaagcgaacaucugcuucaccagucccugguaggcaagaggucucccuuccagaacgcuuacaauauucgggguaacgccacaagcauccaaaucauuuga

SEQ ID NO: 6052 - RNA, 1449 nt, Artificial Sequence
  derived and/or modified CDS sequence (opt3) from NSDV(616287)__HQ286605.1__N
augcagaaccaaaucguggccgacaauaaggaugcuauucuggcauggcacaaaaccuacagcgagaagcauaaacucaaguccguccuuacaaacucugccucauucugcgaaacuauacccgaccugaguggcuaugagguuagcaugagauugguguccucugaaucggagaaagauucaguauacgcgagcgcuuuaguggccgcaacgaaguuuugugccccuauccuggaaugcgcuuggaccaguuguacagggaugauucagaggggacuagacugguucgauaauaacggugagauggucaagaucugggacgcagauuauggcaaacuccggacugaggugccauccccggaacagcugcuuggguaccagcgcgccgcucugaaguggcgaaaagacaccaaguauggaauuaauaaaaacacagccgcguuggcagccgcuaucgccaccgaguaccguguucccggcucuauaguggucaaugugaaggauaugcucagcgacaugaucagaaggcggaacaagauucugaaucgcgaugguuccgaagacguaccuaaaaaggggccaguuucaaaagagcacguggauugggcaagagaccuggcucaaggaaaguuucucgucguguucaaucccccuuggggcgacaucaacaaagccggcaagagugggauugcguuagccgcaacuggaauggcuaaacugaucgagcuugaugguccaaagguggccgaagacuugaaggagagccugaaaucucuagucgcuuggauaaacgcccauaaggaugaaguugagaauggcaaagaagugguagacgggcucacaaagcaucugcagaaagcacuugagcuggccaagcaguccucagcuaugagggcgcagggagcacaaauugauaccguguuuagcaguuauuacugguuguggaaggccggcgucacggcugagauguuccccacugugucucaguuucucuucgaacuggguaaaguuccucgggggaacaagaaaaugaagaaagccuuauccagcaugccacugaaguggggaaagaaacuccuugcacuguuugccgacgauucguucaccgcuaaucgcaucuacaugcacccgggcguguugacagccggccgaaugucugagcuaggggucugcuuuggagcaauucccguggcgaacccugacgaugcugccgaagguuccggccacaucaagaacauccugaauuauaaaacugacacccaggcagggaacccaugugcccagaauauuguagcucucuucaacauacaaaaggccggauuugauaucgagucaauggacauuguugcaagugaacaucugcuucaccagagccuggugggcaaaagaucccccuuccagaaugcuuacaacaucagggguaaugccacaucuauacaaauuaucuga

SEQ ID NO: 6053 - RNA, 1449 nt, Artificial Sequence
  derived and/or modified CDS sequence (opt3) from NSDV(615526)__HQ286606.1__N
augcagaaccaaaucguggccgacaauaaggaugcuauucuggcauggcacaaagccuacagcgagaagcauaaacucaaguccguccuuaccaacucugcgucauucugcgaaacaauacccgaccugaguggcuaugagguuagcaugagauugguguccucugaaucggagaaagauucaguauacgcuagcgccuuaguggcagccacuaaguuuugugcuccuauccuggaaugcgcauggacgaguuguaccgggaugauucagaggggacuagacugguucgauuccaauggugagauggucaagaucugggacgccgauuauggcaaacuccggacagaggugccaucuccggaacagcugcuuggguaccagcgcgcugcccugaaguggcgaaaagacacuaaguauggaauuaacaaaaauaccgcggcauuggccgcugccaucgcaacagaguaccguguucccggcagcauaguggucaacgugaaggauaugcucuccgacaugaucagaaggcggaauaagauucugaaccgcgaugguucagaagacguaccuaaagggggaccaguuaguaaggagcacaucgauugggcuagagaccuggcccaaggcaaauuucucguggucuucaaucccccuuggggcgacauuaacaaggcggggaaaagcggaaucgccuuagcagcuaccgguauggccaagcugauagagcuugauggcccaaaaauugcugaagacuugaaggagucucugaagucccuaguggccuggaucaaugcacauaaagaugaaguggagaacgggaaggaagucguugacggacucacuaaacaucugcagaaggcccuugagcuggcuaaacagucaagcgcgaugagggcacagggcgcccaaauugauacaguguuuaguucuuauuacugguuguggaaggcugguguaaccgccgagauguuccccacggugucccaguuucucuucgaacuggggaaggucccucggggaaauaaaaagaugaaaaaggcauuaagcucgaugccacugaaauggggcaagaagcuccuugcccuguuugcugacgauucuuucacugccaaccgcaucuacaugcacccgggcguguugaccgcagggcgaauguccgagcuaggaguuugcuuuggugcgauccccguggcuaauccugacgaugccgcagaaggcucagggcacauuaaaaacauacugaacuauaagacagacacucaggccggaaauccaugugcucagaacaucgucgcccucuucaauauucaaaaagcaggcuuugauaucgagaguauggacauaguggcuagcgaacaucugcuucaccagucccugguagguaagagaucucccuuccagaacgccuacaauauuagggggaacgcgaccagcauccaaaucauuuga

SEQ ID NO: 6054 - RNA, 1449 nt, Artificial Sequence
  derived and/or modified CDS sequence (opt3) from NSDV(708)__AF504293.1__N
augcagaaccaaaucguggccgacaauaaggaugcuauucuggcauggcacaaagccuacagcgagaagcauaaacucaaguccguccuuaccaacucugcgucauucugcgaagcuauacccgaccugaguggcuaugagguuagcaugagauugguguccucugauucggaaaaagacucaguauacgccagcgcauuaguggccgcuacaaaguuuugugcaccuauccuggagugcgccuggacgaguuguacugggauggucgaaaggggacuagauugguucgagaauaaccgggagauggugaagauuugggacaccgaauaugguaaacuccgcacagagguuccauccccggaacagcugcuuggcuaccagcgagcugcccugaaguggcguaaagauacuaaguaugggaucaauaaaaacaccgcggcauuggccgcugccauugcaacagaguacaaggugcccggaucucucgucgugaauguaaaggacaugcugagcgauaugaucagaaggcggaacaaaauacugaaucgcgacggcuccgaggauguuccuaagagagguccagugucaaaagaacacaucgacugggcuagggaucucgcccaggggaaguuuuuagucguguucaaucccccuuggggagacauuaacaaagcgggcaagaguggcaucgcccuggcagcuaccgggauggccaaacuuauugaguuggacggaccaaagaucgcugaagaucugaaggagagccuaaaaucucucguggccuggauaaacgcacauaaggacgaagucgagaaugguaaagagguuguggauucccugacuaaguaucuucaaaaagcccuggaauuggcuaagcagucaagcgcgaugcgggcacagggcgcccagauugacacaguauuuaguucuuacuacuggcucuggaaggcuggggugaccgccgagauguuccccacggucucccaauuucuguucgaauuaggaaaagugccucgcggcaacaagaaaaugaagaaagcacugagcucgaugccacucaagugggguaagaaacuucuggccuuguuugcugaugacucuuucacugccaaucgaaucuauaugcacccggggguucuaaccgcaggaagaauguccgagcugggcgugugcuuuggcgcgauucccgucgcuaacccugaugacgccgcagaugggucaggacauaucaagaguauccucaacuacaaaacagacacucaggccgguaauccaugugcucagaacauuguggcccuguucaauauacagaaggcaggcuuugauaucgaaagcauggacauuguagcuuccgagcaccuucugcaccaaucuuugguugggaaaaggagccccuuccagaacgccuauaauauccggggaaacgcgaccucaauacagauuaucuga

SEQ ID NO: 6055 - RNA, 702 nt, Artificial Sequence
  derived and/or modified CDS sequence (opt3) from BUNV__NC_001927.1__N
augaucgagcuggaguuccacgacguggccgcuaacaccagcuccacauuugaucccgaagucgcauacgccaauuucaagagaguucauacuacgggccucucuuaugaccacauuaggauauuuuacaucaaagggcgggaaauuaagaccucacuugcgaaacgcagugagugggaagugacacugaacuugggagguuggaagaucacuguauauaauaccaacuucccuggcaaucgaaacaauccagugccggaugacggguuaacacugcaucgucuaagcggauuucucgcuagauaccugcuugagaaaaugcugaaggucuccgagcccgaaaaguugauuaucaaaucuaagauaaucaacccucucgccgagaaaaauggcauuaccuggaacgauggugaagagguguaucugucguucuuuccagggucagagauguuccugggaacuuuuagguucuacccccucgcaaucggcauuuauaagguucagcggaaagaaauggagccuaaguacuuagaaaagacaaugcgccaaagauacaugggccuggaggccgcuaccuggacggugagcaaacuuacugaaguccagagugcauugaccgugguauccucucugggguggaagaaaacaaauguuagcgccgcugccagggacuuucuagcgaaguucggaaucaacauguga

SEQ ID NO: 6056 - RNA, 702 nt, Artificial Sequence
  derived and/or modified CDS sequence (opt3) from BUNV(SFCrEq231)__KP063894.1__N
augaucgagcuggaauuuaacgacguggccgcuaauaccagcuccacauuugaucccgaggucgcauacauuaacuucaagagaauauauacuacgggccucucuuacgaccacaucaggauuuucuauaucaaagggcgggaaauuaagaccucacuuacaaaacgcagugagugggaaguuacucugaauuugggagguuggaaggugaccguauucaacacaaauuuuccuggcaaccgaaauagcccagugccggaugacggguuaacccugcaucgucuauccggauuccucgccagauaccugcuugagaaaauccugaaggucucugagcccgaaaaguugauaaucaaaucgaagauuaucaacccucucgcggagaaaaauggcauuacuuggucagauggugaagagguguaucugagcuuuuucccagggagugagauguuucugggaacauucaaguuuuacccccucgcuaucggcauauauaaaguucagaggaaggaaauggagccuaaguacuuagagaaaaccaugcggcaacgcuacaugggccuggaagccuccacguggacugugucuaaggucaacgaagugcagagcgcacuuaccguaguuuccggguugggauggaaaaagacaaaugugucagccgcugcaagagaguuccuggccaaauuugguauuaacauguga

SEQ ID NO: 6057 - RNA, 702 nt, Artificial Sequence
  derived and/or modified CDS sequence (opt3) from BUNV(AMH001130)__JF961342.1__N
augaucgagcuggaguuccacgacguggccgcuaacaccagcuccacauuugaucccgaagucgcauacgccaauuucaagagaguucauacuacgggccucucuuaugaccacauuaggauauuuuacaucaaagggcgggaagugaagaccucacuugcgaaacgcagugagugggaaguaacacugaacuugggagguuggaagauuacuguguauaauaccaacuucccuggcaaucgaaacaauccagucccggaugacggguuaacacugcaucgucuaagcggauuucucgcuagauaccugcuugagaaaaugcugaagguguccgagcccgaaaaguugaucauuaaaucuaagaucauaaacccucucgccgagaaaaauggcaucaccuggaacgauggugaagagguuuaucugucguucuuuccagggucagagauguuccugggaacuuuuagguucuacccccucgcaauuggcaucuauaaggugcagcggaaagaaauggagccuaaguacuuagaaaagacaaugcgccaaagauacaugggccuggaggccgcuaccuggacggucagcaaacuuacugaagugcagagugcauugaccguaguuuccucucugggguggaagaaaacaaaugugagcgccgcugccagggacuuucuagcgaaguucggaauuaacauguga

SEQ ID NO: 6058 - RNA, 702 nt, Artificial Sequence
  derived and/or modified CDS sequence (opt3) from BUNV(ArB29051)__AM709778.1__N
augaucgagcuggaguuccacgacguggccgcuaacaccagcuccacauuugaucccgaagucgcauacgccaauuucaagagaguucauacuacgggccucucuuaugaccacauuaggauauuuuacaucaaagggcgggaaauuaagaccucacuugcgaaacgcagugagugggaagugacacugaacuugggagguuggaagaucacuguauauaauaccaacuucccuggcaaucgaaacaauccagugccggaugacggguuaacacugcaucgucuaagcggauuucucgcuagauaccugcuugagaaaaugcugaaguuguccgagcccgaaaagcucauuaucaaaucuaagauaaucaacccucuggccgagaaaaauggcauuaccuggaacgauggugaagaggucuaucugucguucuuuccagggucagagauguuccucggaacuuuuagguucuaccccuuagcaaucggcauuuauaaggugcagcggaaagaaauggagccuaaguaccuggaaaagacaaugcgccaaagauacaugggccuugaggccgcuaccuggacgguuagcaaauugacugaagugcagagugcacugaccgucguguccucucuaggguggaagaaaacaaauguaagcgccgcugccagggacuuucucgcgaaguucggaaucaacauguga

SEQ ID NO: 6059 - RNA, 702 nt, Artificial Sequence
  derived and/or modified CDS sequence (opt3) from BUNV(ArB28215)__AM711130.1__N
augaucgagcuggaauuuaacgacguggccgucaauaccagcuccucuuuugaucccgaggcugcauacgccaacuucaagagaguucacacaacuggccucucauaugaccauauuaggauauuuuacaucaaagggcgggaaauuaaggugagucuuagcaaacgcuccgagugggaaguaacgaucaaucugggagguuggaagauugcgguguauaacaccaauuucccuggcaaccgaaauucuccagucccggaugacggguugacauuacaccgucugucgggauuucuagcuagauuccuccuggagaaaaugcuuaagaugucagagcccgaaaagcugaucauaaaagccaagaucauuaacccuuuggcagagaaaaauaggaucacuuggaacgauggcgaagagguguaccucagcuuuuucccagguagugagauguuucuggggaccuucaaguuuuauccccuggccauuggaaucuacaaaguucagcggaaggaaauggagccuaaguauuucgaaaagacaaugcgccaaagauacaugggccucgaggcuuccucuuggaccgugagcaaauuaacugacguccaguccgcacugacagugguaucaggccuuggguggaaaaagaccaauguuagugccgcugccagggauuucuuggcgaaauucggaauaaacauguga

SEQ ID NO: 6060 - RNA, 702 nt, Artificial Sequence
  derived and/or modified CDS sequence (opt3) from BUNV(Peurto Almendras)__AJ697960.1__N
augagcgagaucgccuucgacgauauuggccagauagcugcauccaccuuuaaccccgacaaucaauacaucggguucaagaaaguguuuacaauuggacugacuuaugaucagaucagaauuuucuuucucaacgguaagaaagccaaggaaacgcuuucuaaaaggucagaggaaaccgucacacugaauuucggcggguggcggaucccuauaguuaacacucacuuuccaggaaaucgcaacaucgacuuggcggaugacgcuuuaacccugcaucgagugaguggcuaccuagcccguuaucuccuggagaagguacuuagcgcacaggaaccggagaaggugauuaucaaaacaagaauuaucaaucccauagccgcuuccaacgguauuaccugggaugacggguacgaggucuaucugucuuucuuuccuggaucggaaugcuucuuggaggcauuuaaguucuacccacucgccaucggcauuuauaaagugcagaagggcaugauggauguuaaauuucuggaaaagacuaugaggcaaaaguacgcugggcuggacgccacaguguggacccagcagaaauacacggaugucaucaaugcgcucuuagugguaaacggacuggguuggaagaaaucaaauguuagcgcagccgcuaaggacuuccuuaguaaauucggcauccagauuuga

SEQ ID NO: 6061 - RNA, 702 nt, Artificial Sequence
  derived and/or modified CDS sequence (opt3) from BUNV__AF325122.1__N
augaucgagcuggaguucaacgacguggccgcuaauaccagcuccacauuugaucccgaagucgcauacauuaacuucaagagacucuauacuacgggccuuucuuacgaccacauaaggaucuuuuauauuaaagggcgggaaaucaagaccucacuggccaaacgcagugagugggaaguuacauugaauuuaggagguuggaaggugacuguauucaacaccaauuuuccuggcaaccgaaauagcccagugccggaugacgggcugacacuacaucgucucuccggauaccuggcgagauaucuucuggagaaaauuuugaaggucucugaucccgagaagcucaucauaaaaucgaagaucauuaacccucuggcugagaaaaauggcaucaccuggucagacggugaagaaguguaccugagcuucuuuccagggagugagauguuccucggaacuuuuagguucuaucccuuagccauuggcaucuacaagguucagcggaaagagauggaaccuaaguaccuggagaagacaaugcgccaaagauauaugggccuugaagcauccaccuggacggugucuaaauugaacgagguccagagcgcccugacugugguauccgggcuaggauggaagaaaaccaauguuucaagugcugcaagggaauuucucgccaaguucgguauaagcauguga

SEQ ID NO: 6062 - RNA, 702 nt, Artificial Sequence
  derived and/or modified CDS sequence (opt3) from Ab-BUNV(Cu20-XJ)__KJ710424.1__N
augcuggagcucgaguucgaagacgugcccaccaacaucggcagcacauuugauccugaauccggguacauuaauuuccagagaaacuaucuuccaggagucacucuggaccaaauaaggaucuuuuacauuaagggucgggagaucaaaaauucuuuggccaagcgcucagaaugggagguuacguuaaaccugggcggguggaaagugccgguacuaaauaccaacuuccccggaaaucgaaguaacgcugugccugauuauggccucacauuucaccguauuagcgguuaccuggcaagauaucuucuggggaaguacuuggccgagacugaaccagagaaacucaucaugaggaccaagauaaucaauccccuggcggaaaagaacggaauuacaugggaguccggcccugaggucuaucugucuuucuuuccaggcgcugaaauguuccucgggaccuuuaaauucuaccccuuagccaucggaauuuacaaggugcagcggaaagagauggacccuaaguuucuggagaaaacuaugcgccagagauaucuugguuuggaugcacagacauggaccacgacuaagcuggacgaaguugaaagggcccuaaagguggucucgggccucggguggaaaaagaccaaugugucaaacgcugcacgggaguuccugagcaaauuuggaauccgcauguga

SEQ ID NO: 6063 - RNA, 702 nt, Artificial Sequence
  derived and/or modified CDS sequence (opt3) from ANADV(2513 Irkutsk)__KT313716.1__N
augaucgaacuggaauuuaacgacguggccgcuaauaccagcuccacauuugaucccgaggucgcauacauuaacuucaagagaauauauacuacgggccucucuuacgaccacaucaggauuuucuauaucaaagggcgggaaauuaagaccucacuugccaaacgcagugagugggaaguuacacugaauuugggagguuggaaggugacuguauucaacaccaauuuuccuggcaaccgaaauagcccagugccggaugacggguuaacacugcaucgucuauccggauuccucgcgagauaccugcuugagaaaauccugaaggucucugaucccgagaaguugauaaucaaaucgaagauuaucaacccucucgcugagaaaaauggcauuaccugggccgacggugaagaaguguaucugucauuuuucccagggagcgagauguuucugggaacuuucagguuuuacccccucgcaaucggcauauauaagguucagcggaaagagauggaaccuaaguacuuagagaagacaaugcgccaaagauacaugggccuggaagccaguaccuggacgguguccaaacuuaacgagguccagucugcuuugacugugguaagcgggcugggauggaagaaaaccaauguuuccucagcagccagggaguuccuagcucgguuugguauuaacauguga

SEQ ID NO: 6064 - RNA, 702 nt, Artificial Sequence
  derived and/or modified CDS sequence (opt3) from ANADV(EIV-23263Tyum)__KT313761.1__N
augaucgaacuggaauuuaacgacguggccgcuaauaccagcuccacauuugaucccgaggucgcauacauuaacuucaagagaauauauacuacgggccucucuuacgaccacaucaggauuuucuauaucaaagggcgggaaauuaagaccucacuugccaaacgcagugagugggaaguuacacugaauuugggagguuggaagaucacuguguucaacaccaauuuuccuggcaaccgaaauagcccaguaccggaugacggguuaacacugcaucgucuauccggauuccucgcgagauaccugcuugagaaaauacugaaggugucugaucccgagaaguugaucauuaaaucgaagaucauuaacccucucgcugagaaaaauggcaucaccugggccgacggugaagaagucuaucugucauuuuucccagggagcgagauguuucugggaacuuucagguuuuacccccucgcaauaggcauuuauaaggugcagcggaaagagauggaaccuaaguacuuagagaagacaaugcgccaaagauacaugggccuggaagccaguaccuggacgguuuccaaacuuaacgaggugcagucugcuuugacugucgugagcgggcugggauggaagaaaaccaauguauccucagcagccagggaguuccuagcucgguuugguaucaacauguga

SEQ ID NO: 6065 - RNA, 702 nt, Artificial Sequence
  derived and/or modified CDS sequence (opt3) from BATV__X73464.1__N
augaucgaacuggaauuuaacgacguggccgcuaauaccagcuccacauuugaucccgaggucgcauacauuaacuucaagagaauauauacuacgggccucucuuacgacaauaucaggauuuucuauaucaaagggcgggaaauuaagaccucacuuaguaaacgcagcgagugggaaguuacacugaacuugggagguuggaaggugacuguauucaauaccaacuuuccuggcaaucgaaacuccccagugccggaugacggguuaacacugcaccgucuaucuggauuccucgccagauaccugcuugagaaaauccugaaggucucggaucccgagaaguugauaaucaaaucaaagauugugaauccucucgcggagaaaaacggcaucaccugggcugacggugaagaaguuuaucugagcuuuuucccagggagugagauguuucugggaacuuucagguuuuacccccucgccauuggcaucuauaaggugcagcggaaagagauggaaccuaaguacuuagagaagacaaugcgccaaagauacaugggccuggaagcauccaccuggacggucucuaaacuuaaugaggugcagagcgccuugacuguaguuuccgggcugggauggaagaaaaccaacgugucaagugcugcaagggaguuccuagccaaguuugguauaagcauguga

SEQ ID NO: 6066 - RNA, 702 nt, Artificial Sequence
  derived and/or modified CDS sequence (opt3) from BATV(668)__KT313687.1__N
augaucgaacuggaguucaacgacguggccgcuaauaccagcuccacauuugaucccgaagucgcauaccucaacuucaagagaauuuauacuacgggccuuucuuacgacaauauaaggaucuuuuauauuaaagggcgggaaaucaagguuucacuggccaaacgcagugagugggaagugaccuugaacuuaggagguuggaagguaacaguguucaauacuaacuuuccuggcaaucgaaacagcccagucccggaugacgggcugacccuacaccgucucuccggauuccuggcgagauaccuucuggagaaaauuuugaaggugucugaucccgagaagcucaucauaaaaucgaagaucauuaauccucuggcugagaaaaacggcaucacauggucagacggugaagaaguuuaucugagcuuuuucccagggagugagauguuucucggaaccuucagguuuuaccccuuagccauuggcaucuauaaggugcagcggaaagagauggaaccuaaguaccuggagaagacuaugcgccaaagauacaugggccuugaagcauccacauggaccgucucuaaauugaaugaggugcagagcgcccugacgguaguuuccgggcuaggauggaagaaaacuaacgugucaagugcugcaagggaguuccucgccaaguuugguauaaauauguga
